(12) United States Patent
Cohen et al.

(10) Patent No.: US 7,067,627 B2
(45) Date of Patent: Jun. 27, 2006

(54) SCHIZOPHRENIA ASSOCIATED GENES, PROTEINS AND BIALLELIC MARKERS

(75) Inventors: Daniel Cohen, Paris (FR); Marta Blumenfeld, Paris (FR); Ilya Chumakov, Vaux-le-Penil (FR); Lydie Bougueleret, Petit Lancy (CH); Bernard Bihain, Cancale (FR); Laurent Essioux, Paris (FR)

(73) Assignee: Serono Genetics Institute S.A. (FR)

( * ) Notice: Subject to any disclaimer, the term of this patent is extended or adjusted under 35 U.S.C. 154(b) by 244 days.

(21) Appl. No.: 10/147,603

(22) Filed: May 16, 2002

(65) Prior Publication Data

US 2003/0219750 A1 Nov. 27, 2003

Related U.S. Application Data

(60) Division of application No. 09/539,333, filed on Mar. 30, 2000, now Pat. No. 6,476,208, which is a continuation-in-part of application No. 09/416,384, filed on Oct. 12, 1994, now abandoned.

(60) Provisional application No. 60/126,903, filed on Mar. 30, 1999, provisional application No. 60/131,971, filed on Apr. 30, 1999, provisional application No. 60/132,065, filed on Apr. 30, 1999, provisional application No. 60/143,928, filed on Jul. 14, 1999, provisional application No. 60/145,915, filed on Jul. 27, 1999, provisional application No. 60/146,453, filed on Jul. 29, 1999, provisional application No. 60/146,452, filed on Jul. 29, 1999, and provisional application No. 60/162,288, filed on Oct. 28, 1999.

(51) Int. Cl.
*C07K 1/00* (2006.01)
*A23J 1/00* (2006.01)

(52) U.S. Cl. .................. 530/350; 530/412; 435/69.1
(58) Field of Classification Search ............. 530/350, 530/412; 435/69.1
See application file for complete search history.

(56) References Cited

U.S. PATENT DOCUMENTS 6,476,208 B1 * 11/2002 Cohen et al. ............ 536/23.1

FOREIGN PATENT DOCUMENTS

| WO | WO 97/27284 A2 | 7/1997 |
|---|---|---|
| WO | WO 98/20165 A2 | 5/1998 |
| WO | WO 00/22122 A2 | 4/2000 |

OTHER PUBLICATIONS

Shallom et al (J. Biol. Chem. (1999) 31:37781–37786).*
Fritzler et al (J. Biol. Chem. (1995) 270(52):31262–31268).*
Database Trembl, Accession No. 002586; Llu, et al., "Molecular cloning and expression of the gene encoding a cysteine proteinase of Spirometra erinacei", *Mol. Biochem. Parasitol.*, 1996, pp. 11–21, vol. 76.
Database Swissprot, Accession No. P12410; McCam, D.F., et al., "Genes encoding the alpha, gamma, delta, and four Fo subunits of ATP synthase constitute an operon in the cyanobacterium Anabaena sp. strain PCC 7120", *J. Bacteriol.*, 1988, pp. 3448–3456, vol. 170.
Database Geneseq. Accession No, V76530; Barash, S.C. et al., "Polynucleotide(s) and proteins derived from *Stapyhlococcus aureus*—stored on computer readable mediums and used in the production of anti–S.aureus vaccines", 1999, XP002155359, –ABSTRACT.
Database Emest. Accession No. AA388085; Marra, et al., "The WashU–HHMI Mouse EST Project", 1996, Unpublished.
Database Embl, Accession No. AC008024; Birren, et al., "Homo Sapiens, clone RP11–4584" 1999, XP002176242.
Antonnarakis, et al., "Linkage and sib–pair analysis reveal potential schizophrenia susceptibility gene on chromosome 13q32", *Am. J. Hum. Genet.*, 1996, p. A210, vol. 59.
Lin, et al., "Suggestive evidence for linkage of schizophrenia to markers on chromosome 13q14.1–q32", *Psychiatric Genetics*, 1995, pp. 117–126, vol. 5, Rapid Science Publishers, XP–00094458.
Inayama, et al., "Positive Association Between a DNA Sequence Variant in the Seratonin 2A Receptor Gene and Schizophrenia", *American Journal of Medical Genetics (Neuropsychiatric Genetics)*, 1996, pp. 103–105, vol. 67; Wiley–Liss, Inc. XP–000944353.
Zhang, et al., "Identification of protein coding regions in the human genome by quadratic discriminant analysis", *Proc. Natl. Acad. Sci. USA*. 1997, pp. 565–568. vol. 94; Genetics PNAS; 0027–B424/97/94565–4.
Chee, et al., "Accessing Genetic Information with HighDensity DNA Arrays", *Science*, 1996, pp. 60–614. vol. 94; XP–002022508.
Detera–Wadleigh, et al., "A high density genome scan detects evidence for a bipolar–disorder susceptibility locus on 13q32 and other potential locl on 1q32 amd 19p11.2", *Proc. Natl. Acad. Sci. USA*, May 1999, pp. 5604–5609, vol. 96; XP002134450.

(Continued)

*Primary Examiner*—Jeffrey Fredman
(74) *Attorney, Agent, or Firm*—Saliwanchik, Lloyd & Saliwanchik

(57) ABSTRACT

The invention concerns the human sbg1, g34665, sbg2, g35017 and g35018 genes, polynucleotides, polypeptides biallelic markers, and human chromosome 13q31-q33 biallelic markers. The invention also concerns the association established between schizophrenia and bipolar disorder and the biallelic markers and the sbg1, g34665, sbg2, g35017 and g35018 genes and nucleotide sequences. The invention provides means to identify compounds useful in the treatment of schizophrenia, bipolar disorder and related diseases, means to determine the predisposition of individuals to said disease as well as means for the disease diagnosis and prognosis.

10 Claims, 22 Drawing Sheets

OTHER PUBLICATIONS

Kruglyak, Leonid, "The use of a genetic map of biallelic markers in linkage studies", Nature Genetics, 1977, pp. 21–24, vol. 17, No. 1, XP002050647.

Lin, et al. "Suggestive evidence for linkage of schizophrenia to markers on chromosome 13 in Caucasian but not Oriental populations", Hum. Genet., 1997, pp. 417–420, vol. 99, Springer–Verlag. 1997.

Brzustowicz, et al., "Linkage of Famlllal Schizophrenia to Chromosome 13q32", Am. J. Hum. Genet., 1999, pp. 1096–1103, vol. 65, The American Society of Human Genetics.

Pulver, et al., "The Johns Hopkins University of Collaborative Schizophrenia Study: An Epidemiologic–Genetic Approach to Test the Heterogeneity Hypothesis and Identify Schizophrenia Susceptibility Genes", Cold Springs Harbor Symposia on Quantitative Biology, 1996, pp. 797–814, vol. LXI, Cold Springs Harbor Laboratory Press.

Straub, et al., "Genome Scan for Schizophrenia Genes: A Detailed Progress Report in an Irish Cohort". Am. J. Med. Genet. (Neuropsychiatr. Genet.), (1997) 74:558. ABSTRACT.

Shaw, et al. "A Genome–Wide Search for Schizophrenia Susceptibility Genes", American Journal of Medical Genetics (Neuropsychiatric Genetics), 1998, pp. 364–376, vol. 61, Wiley–Liss, Inc.

Osoegawa, et al., "A Bacterial Artificial Chromosome Library for Sequencing the Complete Human Genome", Genome Research, 2001, pp. 483–496, vol. 11, Cold Spring Harbor Laboratory Press.

RPCI–11 Human Male BAC Library, two pages, http://www.chorl.org/bacpac/hmale11.htm.

Blouin,.et al., Schizophrenia Susceptibility Loci on Chromosomes 13q32 and 8p21, Nature Genetics, 1998, pp. 70–73, vol. 20, No. 1, XP000944108.

Lander, et al., Genetic Dissection of Complex Traits, 1994, Science, pp. 2037–2046, vol. 265.

Osoegawa et al., "An improved approach for construction of bacterial artificial chromosome libraries", Genomics, pp. 1–8, vol. 52.

Li, S–H et al., "Novel Triplet Repeat Containing Genes in Human Brain: Cloning, Expression, and Length Polymorphisms", Genomics, 1993, pp. 572–579, vol. 16, No. 3, XP000195589, U.S. Academic Press, San Diego, CA.

Wang, et al., "Large–scale identification, mapping and genotyping of single–nucleotide polymorphisms in the human genome", Science, 1996, pp. 1077–1082, vol. 280, XP0022089398.

Wright, et al., "Schizophrenia and HLA: A review", Schizophrenia Research, 2001, pp. 1–12, vol. 47, No. 1.

EMBL Database Accession No. B75361; Adams et al., "Use of BAC and sequences for sequence–ready map building", 1998, XP002135179, Unpublished.

EMBL/Genbank Databases, Accession No. AA989298, "National Cancer Institute, Cancer Genome Anatomy Project (CGAP), Tumor Gene Index, http://www.ncbi.nlm.gov/ncicgap", XP002135005, Unpublished.

& EMBL/Genebank Databases, Accession No. L10374, Sequence Reference HSMRNAC, Jun. 1993, XP002134451.

Kruglyak, L. "Passage text. The use of a genetic map of bialielo markers in linkage studies", Nature Genetics, 1997, pp. 22–24, vol. 17, No. 1, New York, New York, XP002050647, ISSN: 1061–4036.

GENBANK H09867, Jun. 23, 1995.

GENBANK H09780, Jun. 23, 1995.

GENBANK AA424106, Oct. 16, 1997.

GENBANK AA420456, Oct. 16, 1997.

Kashima, et al., "Role of unique consecutive glutamine repeats in active murine interleukin–2 molecule", J. Biochem., 1987, pp. 726–732, vol. 102.

Wimmer et al., "A drosphilia homologue of human SP1 is a head specific segmentation gene", Nature, pp. 690–694, vol. 366.

Hanson, et al., "Systemic lupus erthyromatosis patients with central nervous system involvement show autoantibodies to a 50kd neuronal membrane protein", J. Exp. Med., pp. 565–573, vol. 176.

* cited by examiner

FIG. 3: Table of haplotypes giving the Maximum positive difference between cases/controls.

| MARKERS | 99-1508/218 | 99-5862/167 | 99-16100/147 | 99-7652/162 | 99-5919/215 | 99-5897/143 | 99-16032/292 | 99-15880/162 | 99-16038/118 | 99-15875/165 | 99-16033/244 | 99-16047/115 | HAPLOTYPE DESCRIPTION ||||| |
|---|---|---|---|---|---|---|---|---|---|---|---|---|---|---|---|---|---|
| | 32.14 (A) | 48.75 (T) | 49.56 (G) | 48.48 (G) | 60.17 (A) | 40.55 (C) | 57.5 (A) | 57.65 (A) | 57.74 (G) | 37.39 (T) | 46.71 (T) | 26.64 (T) | Frequency$^{(1)}$ || Statistics on a haplotype$^{(3)}$ || |
| frequency in controls (Allele) | 1.4 | 7.6 | 5.8 | 5.6 | 9.2 | 3.1 | 6.1 | 7 | 7 | 5.7 | 1.8 | 3 | Cases | Controls | OR | p-value (1df)$^{(4)}$ | |
| diff (cases-controls) | 0.66 | 0.02 | 0.09 | 0.09 | 0.00355 | 0.34 | 0.06 | 0.03 | 0.03 | 0.08 | 0.58 | 0.32 | | | | | |
| Single association (p-value) | ·· | ·· | · | · | ··· | · | · | · | ·· | · | | | | | | | |
| haplotype 1 | | | | | A | | | | | | | | 0.288 | 0.195 | 1.67 | 1.20E-03 | *** |
| haplotype 2 | | T | | | | | | | | | | | 0.238 | 0.155 | 1.71 | 1.70E-03 | *** |
| haplotype 3 | A | | | | | | | | | | | | 0.223 | 0.144 | 1.71 | 2.60E-03 | *** |
| haplotype 4 | | | G | | | | | | | | | | 0.173 | 0.105 | 1.79 | 3.40E-03 | *** |
| haplotype 5 | | | | G | | | | | | | | | 0.231 | 0.159 | 1.59 | 7.70E-03 | *** |
| haplotype 6 | | | | | | C | | | | | | | 0.306 | 0.228 | 1.49 | 8.60E-03 | ** |
| haplotype 7 | | | | | | | A | | | | | | 0.305 | 0.229 | 1.48 | 9.60E-03 | ** |
| haplotype 8 | | | | | A | | | | | | | | 0.4 | 0.319 | 1.42 | 1.00E-02 | ** |
| haplotype 67 | A | | | | | | | | G | | | | 0.124 | 0.043 | 3.18 | 1.30E-05 | ***** |
| haplotype 68 | A | | | G | | | A | | | | | | 0.121 | 0.042 | 3.13 | 2.00E-05 | ***** |
| haplotype 69 | A | | G | G | | C | | | G | | | | 0.13 | 0.048 | 2.96 | 2.60E-05 | ***** |
| haplotype 70 | | | A | | A | A | | | | T | | | 0.188 | 0.091 | 2.32 | 2.90E-05 | ***** |
| haplotype 71 | A | | A G | G | | | | | | | | | 0.094 | 0.026 | 3.88 | 3.40E-05 | ***** |
| haplotype 72 | A | | | | | | A | A | | | | | 0.127 | 0.047 | 2.92 | 3.70E-05 | ***** |
| haplotype 73 | A | | G | | | | | A | | | | | 0.121 | 0.044 | 3.01 | 3.90E-05 | ***** |
| haplotype 74 | A | | | | A | | | | G | | T | | 0.128 | 0.049 | 2.85 | 4.90E-05 | ***** |
| haplotype 75 | | | | | A | | | | | | | | 0.143 | 0.062 | 2.55 | 5.40E-05 | ***** |
| haplotype 76 | | C | | | | | | | | | | | 0.098 | 0.033 | 3.15 | 1.00E-04 | **** |
| haplotype 287 | A | | G | G | | | | | G | | | | 0.138 | 0.038 | 4.01 | 3.10E-07 | ******* |
| haplotype 288 | | | G | G | A | | | | G | | | | 0.138 | 0.04 | 3.84 | 4.20E-07 | ****** |
| haplotype 289 | | C | | | A | | A | | | | | | 0.135 | 0.038 | 3.94 | 5.40E-07 | ****** |
| haplotype 290 | | | | | A | C | A | | | | T | | 0.086 | 0.013 | 6.93 | 6.70E-07 | ****** |
| haplotype 291 | A | | G | | A | | | | | | | | 0.134 | 0.04 | 3.75 | 8.20E-07 | ****** |

$^{a}$maxM: Table of haplotypes giving the Maximum positive difference between cases/controls.
1: Frequency of the haplotype leading to the maximum chi-square test.
2: Test on the frequency of this haplotype in cases vs. in controls.
3: p-value assuming that the test has a chi-square distribution with 1 degree of freedom.

FIG. 4

| markers | 2-mks<br>$\leq 10^{-2}$<br>7 | 3-mks<br>$\leq 10^{-5}$<br>10 | 4-mks<br>$\leq 10^{-6}$<br>5 |
|---|---|---|---|
| 99-16082/218 | * | * | * |
| 99-5852/167 | * | * | * |
| 99-16100/147 | * | * | * |
| 99-7652/162 | * | * | * |
| 99-5919/215 | * | * | * |
| 99-5897/143 | * | * | * |
| 99-16032/292 | * | * |  |
| 99-15880/162 | * | * |  |
| 99-16038/118 | * | * |  |
| 99-15875/165 | * | * |  |
| 99-16033/244 |  | * | * |
| 99-16047/115 |  |  | * |

Legend:
- # of markers in the haplotype
- Threshold of significance
- # of haplotypes concerned

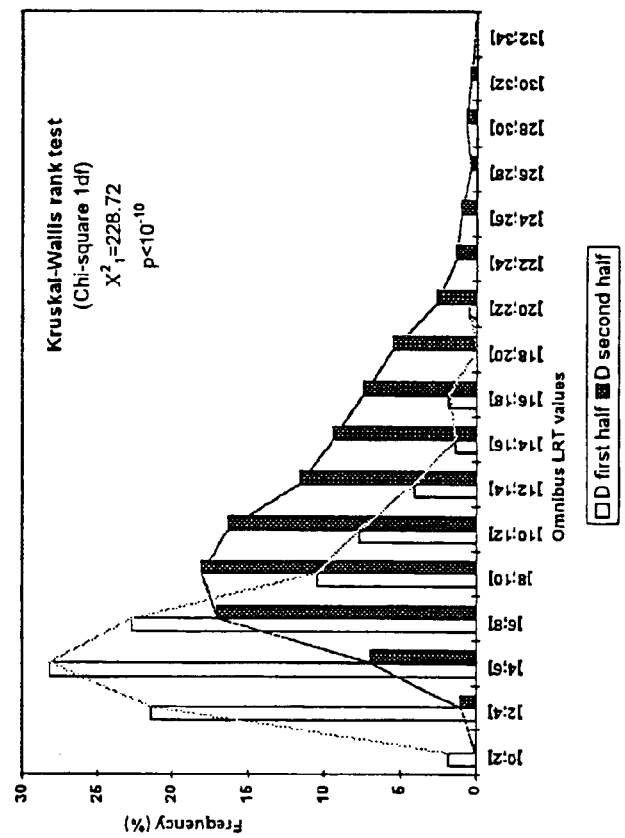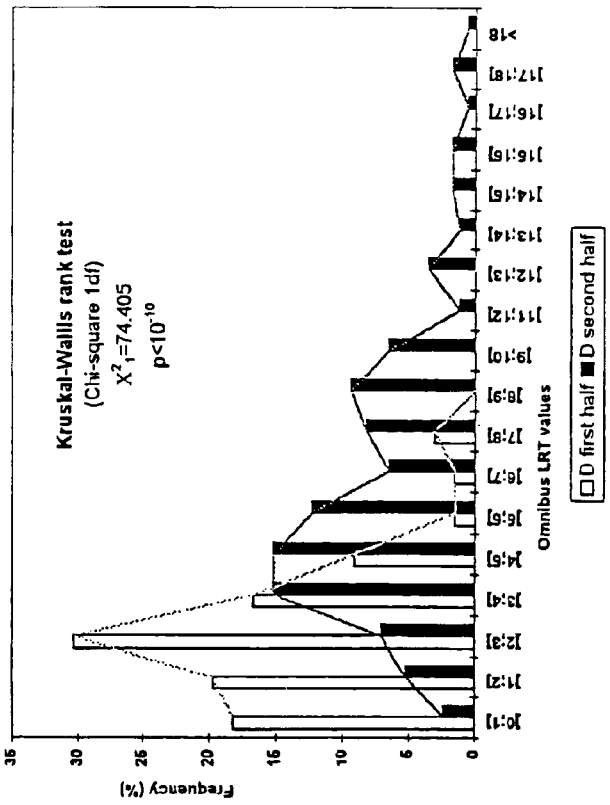
FIG. 7A
FIG. 7B

FIG. 12

| | | First screening cases vs First screening controls | HC cases vs All controls | FH+ cases vs All controls | FH- cases vs All controls |
|---|---|---|---|---|---|
| SINGLE POINT ANALYSIS | | | | | |
| HARDY WEINBERG Disequilibrium coefficient (Da) EXCESS OF HETEROZYGOTES | Cases | 2,79 % (15) | 2,25 % (32) | 7,03 % (32) | 2,81 % (32) |
| | Controls | 3,075 % (18) | 2,25 % (32) | 2,25 % (32) | 2,25 % (32) |
| HARDY WEINBERG Disequilibrium coefficient (Da) EXCESS OF HOMOZYGOTES | Cases | 0,16 % (17) | 0,075 % (32) | 0,44 % (32) | 0,38 % (32) |
| | Controls | 0,865 % (14) | 0 % (32) | 0 % (32) | 0 % (32) |
| ALLELIC ASSOCIATION ANALYSIS & frequency difference | | 2.8E-02 (32) | 1.4E-02 (32) | 3.6E-02 (32) | 2.4E-02 (32) |
| | | 8,945 % (32) | 8,33 % (32) | 9,62 % (32) | 8,535 % (32) |
| GENOTYPIC ASSOCIATION ANALYSIS | | 3.7E-02 (32) | 3.5E-02 (32) | 3.2E-02 (32) | 3.2E-02 (32) |
| LOGISTIC REGRESSION ANALYSIS | Dominant model | 1.4E-02 (32) | 1.7E-02 (32) | 2.2E-02 (32) | 2.2E-02 (32) |
| MULTIPOINT ANALYSIS | | | | | |
| PVALUE FOR HAPLOTYPE (in function of haplotype giving the max positive difference between cases vs controls) | 2 POINTS | 8.4E-03 (130) | 4.9E-03 (130) | 6.5E-03 (129) | 4.9E-03 (130) |
| | 3 POINTS | 1.4E-03 (366) | 9.7E-04 (366) | 7.0E-04 (364) | 1.1E-03 (366) |
| HAPLOTYPE Frequency difference (%) | 2 POINTS | 10.8 (130) | 8.855 (130) | 10.46 (129) | 9.455 (130) |
| | 3 POINTS | 10 (366) | 8.25 (366) | 11.785 (364) | 9.45 (366) |
| PVALUE FOR HAPLOTYPE (in function of haplotype giving the max negative difference between cases vs controls) | 2 POINTS | 1.5E-05 (130) | 6.7E-05 (130) | 4.3E-05 (120) | 1.3E-03 (130) |
| | 3 POINTS | 6.7E-06 (366) | 6.4E-06 (366) | 1.2E-05 (352) | 3.2E-04 (366) |
| HAPLOTYPE Frequency difference (%) | 2 POINTS | 12.2 (130) | 9.855 (130) | 10.395 (120) | 9.3 (130) |
| | 3 POINTS | 12.375 (366) | 9.875 (366) | 13.39 (352) | 9.175 (366) |
| Likelihood Ratio test | 2 POINTS | 14.313 (130) | 16.0015 (130) | 13.226 (129) | 12.172 (130) |
| | 3 POINTS | 23.07 (366) | 26.215 (366) | 23.537 (364) | 19.91 (366) |

| | | | European caucasian cases (92) vs All Algene controls (241) | European caucasian cases (92) vs random controls (188) |
|---|---|---|---|---|
| SINGLE POINT ANALYSIS | HARDY WEINBERG Disequilibrium coefficient (Da) EXCESS OF HETEROZYGOTES | Cases | -7,015 % (18) | -7,015 % (18) |
| | | Controls | -2,25 % (14) | -3,415 % (20) |
| | HARDY WEINBERG Disequilibrium coefficient (Da) EXCESS OF HOMOZYGOTES | Cases | 0,2 % (13) | 0,2 % (13) |
| | | Controls | 0 % (18) | 0,055 % (12) |
| | ALLELIC ASSOCIATION ANALYSIS & frequency difference | | 4.2E-02 (32) 8,485 % (32) | 5.6E-02 (32) 8,29 % (32) |
| | GENOTYPIC ASSOCIATION ANALYSIS | | 4.9E-02 (32) | 3.8E-02 (32) |
| | LOGISTIC REGRESSION ANALYSIS | Dominant model | 7.5E-02 (32) | 3.4E-02 (32) |
| MULTIPOINT ANALYSIS | PVALUE FOR HAPLOTYPE (in function of haplotype giving the max positive difference between cases vs controls) | 2 POINTS | 5.9E-03 (129) | 1.7E-02 (129) |
| | | 3 POINTS | 3.6E-04 (362) | 2.6E-03 (365) |
| | HAPLOTYPE Frequency difference (%) | 2 POINTS | 9.72 (129) | 10.96 (129) |
| | | 3 POINTS | 10.6 (362) | 10.78 (365) |
| | PVALUE FOR HAPLOTYPE (in function of haplotype giving the max negative difference between cases vs controls) | 2 POINTS | 1.2E-02 (130) | 3.1E-02 (129) |
| | | 3 POINTS | 1.7E-03 (363) | 2.9E-03 (365) |
| | HAPLOTYPE Frequency difference (%) | 2 POINTS | 10.755 (130) | 10.16 (129) |
| | | 3 POINTS | 11.27 (363) | 10.6 (365) |
| | Likelihood Ratio test | 2 POINTS | 8.376 (129) | 7.6 (129) |
| | | 3 POINTS | 15.2595 (362) | 13.654 (365) |

| | | | All caucasian vs controls | Bipolar I vs controls | Bipolar II vs controls |
|---|---|---|---|---|---|
| SINGLE POINT ANALYSIS | HARDY WEINBERG Disequilibrium coefficient (Da) *EXCESS OF HETEROZYGOTES* | Cases | 2,415 % (18) | 3,4 % (16) | 6,055 % (18) |
| | | Controls | 2,775 % (18) | 2,775 % (18) | 2,775 % (18) |
| | HARDY WEINBERG Disequilibrium coefficient (Da) *EXCESS OF HOMOZYGOTES* | Cases | 0,065 % (14) | 0 % (16) | 1,055 % (14) |
| | | Controls | 0,265 % (14) | 0,265 % (14) | 0,265 % (14) |
| | ALLELIC ASSOCIATION ANALYSIS | | 1.5E-01 (32) | 1.8E-01 (32) | 6.6E-02 (32) |
| | & frequency difference | | 5,56 % (32) | 5,49 % (32) | 9,25 % (32) |
| | GENOTYPIC ASSOCIATION ANALYSIS | | 1.1E-01 (32) | 1.9E-01 (32) | 4.9E-02 (32) |
| | LOGISTIC REGRESSION ANALYSIS | Dominant model | 6.2E-02 (32) | 1.2E-01 (32) | 4.9E-02 (32) |
| MULTIPOINT ANALYSIS | PVALUE FOR HAPLOTYPE (in function of haplotype giving the max positive difference between cases vs controls) | 2 POINTS | 1,01E-02 (130) | 3.1E-02 (128) | 7.42E-03 (129) |
| | | 3 POINTS | 4.3E-04 (361) | 1.9E-03 (354) | 2.33E-03 (362) |
| | HAPLOTYPE Frequency difference (%) | 2 POINTS | 7.61 (130) | 8.255 (128) | 10.58 (129) |
| | | 3 POINTS | 7.7 (361) | 9.6 (354) | 10.595 (362) |
| | PVALUE FOR HAPLOTYPE (in function of haplotype giving the max negative difference between cases vs controls) | 2 POINTS | 5.17E-03 (130) | 9.9E-03 (130) | 2.59E-02 (130) |
| | | 3 POINTS | 6.3E-04 (366) | 1.9E-03 (366) | 4.45E-03 (366) |
| | HAPLOTYPE Frequency difference (%) | 2 POINTS | 9.41 (130) | 10.185 (130) | 10.7 (130) |
| | | 3 POINTS | 10.5 (366) | 11.45 (366) | 11.5 (366) |
| | Likelihood Ratio test | 2 POINTS | 10.851 (130) | 7.4745 (128) | 7.896 (129) |
| | | 3 POINTS | 27.01 (361) | 20.0225 (354) | 16.6645 (362) |

SCHIZOPHRENIA ASSOCIATED GENES, PROTEINS AND BIALLELIC MARKERS

RELATED APPLICATIONS

This application is a divisional of U.S. patent application Ser. No. 09/539,333, filed Mar. 30, 2000, now U.S. Pat. No. 6,476,208, which is a continuation-in-part of U.S. patent application Ser. No. 09/416,384, filed Oct. 12, 1999 which claims the benefit under 35 USC 119(e) of U.S. Provisional Applications 60/103,955, filed Oct. 13, 1998; 60/106,457, filed Oct. 30, 1998; and 60/132,777, filed May 3, 1999, U.S. patent application Ser. No. 09/539,333 claims benefit under 35 USC 119(e) of U.S. Provisional Patent Application Nos. 60/126,903, filed Mar. 30, 1999; 60/131,971, filed Apr. 30, 1999; 60/132,065, filed Apr. 30, 1999; 60/143,928, filed Jul. 14, 1999; 60/145,915, filed Jul. 27, 1999; 60/146,453, filed Jul. 29, 1999; 60/146,452, filed Jul. 29, 1999; and 60/162,288, filed Oct. 28, 1999. The following applications are hereby incorporated by reference in their entireties: U.S. patent application Ser. No. 09/539,333, filed Mar. 30, 2000; U.S. patent application Ser. No. 09/416,384, filed Oct. 12, 1999; U.S. Provisional Patent Application Nos. 60/126,903, filed Mar. 30, 1999; 60/131,971, filed Apr. 30, 1999; 60/132, 065, filed Apr. 30, 1999; 60/143,928, filed Jul. 14, 1999; 60/145,915, filed Jul. 27, 1999; 60/146,453, filed Jul. 29, 1999; 60/146,452, filed Jul. 29, 1999; and 60/162,288, filed Oct. 28, 1999.

FIELD OF THE INVENTION

The invention concerns the human sbg1, g34665, sbg2, g35017 and g35018 genes, polynucleotides, polypeptides biallelic markers, and human chromosome 13q31-q33 biallelic markers. The invention also concerns the association established between schizophrenia and bipolar disorder and the biallelic markers and the sbg1, g34665, sbg2, g35017 and g35018 genes and nucleotide sequences. The invention provides means to identify compounds useful in the treatment of schizophrenia, bipolar disorder and related diseases, means to determine the predisposition of individuals to said disease as well as means for the disease diagnosis and prognosis.

BACKGROUND OF THE INVENTION

Advances in the technological armamentarium available to basic and clinical investigators have enabled increasingly sophisticated studies of brain and nervous system function in health and disease. Numerous hypotheses both neurobiological and pharmacological have been advanced with respect to the neurochemical and genetic mechanisms involved in central nervous system (CNS) disorders, including psychiatric disorders and neurodegenerative diseases. However, CNS disorders have complex and poorly understood etiologies, as well as symptoms that are overlapping, poorly characterized, and difficult to measure. As a result future treatment regimes and drug development efforts will be required to be more sophisticated and focused on multigenic causes, and will need new assays to segment disease populations, and provide more accurate diagnostic and prognostic information on patients suffering from CNS disorders.

Neurological Basis of CNS Disorders

Neurotransmitters serve as signal transmitters throughout the body. Diseases that affect neurotransmission can therefore have serious consequences. For example, for over 30 years the leading theory to explain the biological basis of many psychiatric disorders such as depression has been the monoamine hypothesis. This theory proposes that depression is partially due to a deficiency in one of the three main biogenic monoamines, namely dopamine, norepinephrine and/or serotonin.

In addition to the monoamine hypothesis, numerous arguments tend to show the value of taking into account the overall function of the brain and no longer only considering a single neuronal system. In this context, the value of dual specific actions on the central aminergic systems including second and third messenger systems has now emerged.

Endocrine Basis of CNS Disorders

It is furthermore apparent that the main monoamine systems, namely dopamine, norepinephrine and serotonin, do not completely explain the pathophysiology of many CNS disorders. In particular, it is clear that CNS disorders may have an endocrine component; the hypothalamic-pituitary-adrenal (HPA) axis, including the effects of corticotrophin-releasing factor and glucocorticoids, plays an important role in the pathophysiology of CNS disorders.

In the hypothalamus-pituitary-adrenal (HPA) axis, the hypothalamus lies at the top of the hierarchy regulating hormone secretion. It manufactures and releases peptides (small chains of amino acids) that act on the pituitary, at the base of the brain, stimulating or inhibiting the pituitarys—s release of various hormones into the blood. These hormones, among them growth hormone, thyroid-stimulating hormone and adrenocorticotrophic hormone (ACTH), control the release of other hormones from target glands. In addition to functioning outside the nervous system, the hormones released in response to pituitary hormones also feed back to the pituitary and hypothalamus. There they deliver inhibitory signals that serve to limit excess hormone biosynthesis.

CNS Disorders

Neurotransmitter and hormonal abnormalities are implicated in disorders of movement (e.g. Parkinson's disease, Huntington's disease, motor neuron disease, etc.), disorders of mood (e.g. unipolar depression, bipolar disorder, anxiety, etc.) and diseases involving the intellect (e.g. Alzheimer's disease, Lewy body dementia, schizophrenia, etc.). In addition, these systems have been implicated in many other disorders, such as coma, head injury, cerebral infarction, epilepsy, alcoholism and the mental retardation states of metabolic origin seen particularly in childhood.

Genetic Analysis of Complex Traits

Until recently, the identification of genes linked with detectable traits has relied mainly on a statistical approach called linkage analysis. Linkage analysis is based upon establishing a correlation between the transmission of genetic markers and that of a specific trait throughout generations within a family. Linkage analysis involves the study of families with multiple affected individuals and is useful in the detection of inherited traits, which are caused by a single gene, or possibly a very small number of genes. But linkage studies have proven difficult when applied to complex genetic traits. Most traits of medical relevance do not follow simple Mendelian monogenic inheritance. However, complex diseases often aggregate in families, which suggests that there is a genetic component to be found. Such complex traits are often due to the combined action of multiple genes as well as environmental factors. Such complex trait, include susceptibilities to heart disease, hypertension, diabetes, cancer and inflammatory diseases. Drug efficacy, response and tolerance/toxicity can also be considered as multifactoral traits involving a genetic component in the same way as complex diseases. Linkage analysis cannot be applied to the study of traits for which no large informative families are available. Moreover, because of their low penetrance, such complex traits do not segregate in a clear-cut Mendelian manner as they are passed from one generation to the next. Attempts to map such diseases have been plagued by inconclusive results, demonstrating the need for more sophisticated genetic tools.

Knowledge of genetic variation in the neuronal and endocrine systems is important for understanding why some people are more susceptible to disease or respond differently to treatments. Ways to identify genetic polymorphism and to analyze how they impact and predict disease susceptibility and response to treatment are needed.

Although the genes involved in the neuronal and endocrine systems represent major drug targets and are of high relevance to pharmaceutical research, we still have scant knowledge concerning the extent and nature of sequence variation in these genes and their regulatory elements. In the case where polymorphisms have been identified the relevance of the variation is rarely understood. While polymorphisms hold promise for use as genetic markers in determining which genes contribute to multigenic or quantitative traits, suitable markers and suitable methods for exploiting those markers have not been found and brought to bear on the genes related to disorders of the brain and nervous system.

The basis for accomplishing these goals is to use genetic association analysis to detect markers that predict susceptibility for these traits. Recently, advances in the fields of genetics and molecular biology have allowed identification of forms, or alleles, of human genes that lead to diseases. Most of the genetic variations responsible for human diseases identified so far, belong to the class of single gene disorders. As this name implies, the development of single gene disorders is determined, or largely influenced, by the alleles of a single gene. The alleles that cause these disorders are, in general, highly deleterious (and highly penetrant) to individuals who carry them. Therefore, these alleles and their associated diseases, with some exceptions, tend to be very rare in the human population. In contrast, most common diseases and non-disease traits, such as a physiological response to a pharmaceutical agent, can be viewed as the result of many complex factors. These can include environmental exposures (toxins, allergens, infectious agents, climate, and trauma) as well as multiple genetic factors, Association studies seek to analyze the distributions of chromosomes that have occurred in populations of unrelated (at least not directly related) individuals. An assumption in this type of study is that genetic alleles that result in susceptibility for a common trait arose by ancient mutational events on chromosomes that have been passed down through many generations in the population. These alleles can become common throughout the population in part because the trait they influence, if deleterious, is only expressed in a fraction of those individuals who carry them. Identification of these "ancestral" chromosomes is made difficult by the fact that genetic markers are likely to have become separated from the trait susceptibility allele through the process of recombination, except in regions of DNA which immediately surround the allele. The identities of genetic markers contained within the fragments of DNA surrounding a susceptibility allele will be the same as those from the ancestral chromosome on which the allele arose. Therefore, individuals from the population who express a complex trait might be expected to carry the same set of genetic markers in the vicinity of a susceptibility allele more often than those who do not express the trait; that is these markers will show an association with the trait.

Schizophrenia

Schizophrenia is one of the most severe and debilitating of the major psychiatric diseases. It usually starts in late adolescence or early adult life and often becomes chronic and disabling. Men and women are at equal risk of developing this illness; however, most males become ill between 16 and 25 years old, while females develop symptoms between 25 and 30. People with schizophrenia often experience both "positive" symptoms (e.g., delusions, hallucinations, disorganized thinking, and agitation) and "negative" symptoms (e.g., lack of drive or initiative, social withdrawal, apathy, and emotional unresponsiveness).

Schizophrenia affects 1% of the world population. There are an estimated 45 million people with schizophrenia in the world, with more than 33 million of them in the developing countries. This disease places a heavy burden on the patient's family and relatives, both in terms of the direct and indirect costs involved and the social stigma associated with the illness, sometimes over generations. Such stigma often leads to isolation and neglect.

Moreover, schizophrenia accounts for one fourth of all mental health costs and takes up one in three psychiatric hospital beds. Most schizophrenia patients are never able to work. The cost of schizophrenia to society is enormous. In the United States, for example, the direct cost of treatment of schizophrenia has been estimated to be close to 0.5% of the gross national product. Standardized mortality ratios (SMRs) for schizophrenic patients are estimated to be two to four times higher than the general population, and their life expectancy overall is 20% shorter than for the general population. The most common cause of death among schizophrenic patients is suicide (in 10% of patients) which represents a 20 times higher risk than for the general population. Deaths from heart disease and from diseases of the respiratory and digestive system are also increased among schizophrenic patients.

Bipolar Disorder

Bipolar disorders are relatively common disorders with severe and potentially disabling effects. In addition to the severe effects on patients' social development, suicide completion rates among bipolar patients are reported to be about 15%.

Bipolar disorders are characterized by phases of excitement and often including depression; the excitement phases, referred to as mania or hypomania, and depression can alternate or occur in various admixtures, and can occur to different degrees of severity and over varying time periods. Because bipolar disorders can exist in different forms and display different symptoms, the classification of bipolar disorder has been the subject of extensive studies resulting in the definition of bipolar disorder subtypes and widening of the overall concept to include patients previously thought to be suffering from different disorders. Bipolar disorders often share certain clinical signs, symptoms, treatments and neurobiological features with psychotic illnesses in general and therefore present a challenge to the psychiatrist to make an accurate diagnosis. Furthermore, because the course of bipolar disorders and various mood and psychotic disorders can differ greatly, it is critical to characterize the illness as early as possible in order to offer means to manage the illness over a long term.

Bipolar disorders appear in about 1.3% of the population and have been reported to constitute about half of the mood disorders seen in a psychiatric clinic. Bipolar disorders have been found to vary with gender depending of the type of disorder; for example, bipolar disorder I is found equally among men and women, while bipolar disorder II is reportedly more common in women. The age of onset of bipolar disorders is typically in the teenage years and diagnosis is typically made in the patient's early twenties. Bipolar disorders also occur among the elderly, generally as a result of a medical or neurological disorder.

The costs of bipolar disorders to society are enormous. The mania associated with the disease impairs performance and causes psychosis, and often results in hospitalization. This disease places a heavy burden on the patient's family and relatives, both in terms of the direct and indirect costs involved and the social stigma associated with the illness, sometimes over generations. Such stigma often leads to isolation and neglect. Furthermore, the earlier the onset, the more severe are the effects of interrupted education and social development.

The DSM-IV classification of bipolar disorder distinguishes among four types of disorders based on the degree and duration of mania or hypomania as well as two types of disorders which are evident typically with medical conditions or their treatments, or to substance abuse. Mania is recognized by elevated, expansive or irritable mood as well as by distractability, impulsive behavior, increased activity, grandiosity, elation, racing thoughts, and pressured speech. Of the four types of bipolar disorder characterized by the particular degree and duration of mania, DSM-IV includes:

bipolar disorder I, including patients displaying mania for at least one week;

bipolar disorder II, including patients displaying hypomania for at least 4 days, characterized by milder symptoms of excitement than mania, who have not previously displayed mania, and have previously suffered from episodes of major depression;

bipolar disorder not otherwise specified (NOS), including patients otherwise displaying features of bipolar disorder II but not meeting the 4 day duration for the excitement phase, or who display hypomania without an episode of major depression; and cyclothymia, including patients who show numerous manic and depressive symptoms that do not meet the criteria for hypomania or major depression, but which are displayed for over two years without a symptom-free interval of more than two months.

The remaining two types of bipolar disorder as classified in DSM-VI are disorders evident or caused by various medical disorder and their treatments, and disorders involving or related to substance abuse. Medical disorders which can cause bipolar disorders typically include endocrine disorders and cerebrovascular injuries, and medical treatments causing bipolar disorder are known to include glucocorticoids and the abuse of stimulants. The disorder associated with the use or abuse of a substance is referred to as "substance induced mood disorder with manic or mixed features".

Diagnosis of bipolar disorder can be very challenging. One particularly troublesome difficulty is that some patients exihibit mixed states, simultaneously manic and dysphoric or depressive, but do not fall into the DSM-IV classification because not all required criteria for mania and major depression are met daily for at least one week. Other difficulties include classification of patients in the DSM-IV groups based on duration of phase since patients often cycle between excited and depressive episodes at different rates. In particular, it is reported that the use of antidepressants may alter the course of the disease for the worse by causing "rapid-cycling". Also making diagnosis more difficult is the fact that bipolar patients, particularly at what is known as Stage III mania, share symptoms of disorganized thinking and behavior with bipolar disorder patients. Furthermore, psychiatrists must distinguish between agitated depression and mixed mania; it is common that patients with major depression (14 days or more) exhibit agitiation, resulting in bipolar-like features. A yet further complicating factor is that bipolar patients have an exceptionally high rate of substance, particularly alcohol abuse. While the prevalence of mania in alcoholic patients is low, it is well known that substance abusers can show excited symptoms. Difficulties therefore result for the diagnosis of bipolar patients with substance abuse.

Treatment

As there are currently no cures for bipolar disorder or schizophrenia, the objective of treatment is to reduce the severity of the symptoms, if possible to the point of remission. Due to the similarities in symptoms, schizophrenia and bipolar disorder are often treated with some of the same medicaments. Both diseases are often treated with antipsychotics and neuroleptics.

For schizophrenia, for example, antipsychotic medications are the most common and most valuable treatments. There are four main classes of antipsychotic drugs which are commonly prescribed for schizophrenia. The first, neuroleptics, exemplified by chlorpromazine (Thorazine), has revolutionized the treatment of schizophrenic patients by reducing positive (psychotic) symptoms and preventing their recurrence. Patients receiving chlorpromazine have been able to leave mental hospitals and live in community programs or their own homes. But these drugs are far from ideal. Some 20% to 30% of patients do not respond to them at all, and others eventually relapse. These drugs were named neuroleptics because they produce serious neurological side effects, including rigidity and tremors in the arms and legs, muscle spasms, abnormal body movements, and akathisia (restless pacing and fidgeting). These side effects are so troublesome that many patients simply refuse to take the drugs. Besides, neuroleptics do not improve the so-called negative symptoms of schizophrenia and the side effects may even exacerbate these symptoms. Thus, despite the clear beneficial effects of neuroleptics, even some patients who have a good short-term response will ultimately deteriorate in overall functioning.

The well known deficiencies in the standard neuroleptics have stimulated a search for new treatments and have led to a new class of drugs termed atypical neuroleptics. The first atypical neuroleptic, Clozapine, is effective for about one third of patients who do not respond to standard neuroleptics. It seems to reduce negative as well as positive symptoms, or at least exacerbates negative symptoms less than standard neuroleptics do. Moreover, it has beneficial effects on overall functioning and may reduce the chance of suicide in schizophrenic patients. It does not produce the troubling neurological symptoms of the standard neuroleptics, or raise blood levels of the hormone prolactin, excess of which may cause menstrual irregularities and infertility in women, impotence or breast enlargement in men. Many patients who cannot tolerate standard neuroleptics have been able to take clozapine. However, clozapine has serious limitations. It was originally withdrawn from the market because it can cause agranulocytosis, a potentially lethal inability to produce white blood cells. Agranulocytosis remains a threat that requires careful monitoring and periodic blood tests. Clozapine can also cause seizures and other disturbing side effects (e.g., drowsiness, lowered blood pressure, drooling, bed-wetting, and weight gain). Thus it is usually taken only by patients who do not respond to other drugs.

Researchers have developed a third class of antipsychotic drugs that have the virtues of clozapine without its defects. One of these drugs is risperidone (Risperdal). Early studies suggest that it is as effective as standard neuroleptic drugs for positive symptoms and may be somewhat more effective for negative symptoms. It produces more neurological side effects than clozapine but fewer than standard neuroleptics. However, it raises prolactin levels. Risperidone is now prescribed for a broad range of psychotic patients, and many clinicians seem to use it before clozapine for patients who do not respond to standard drugs, because they regard it as safer. Another new drug is Olanzapine (Zyprexa) which is at least as effective as standard drugs for positive symptoms and more effective for negative symptoms. It has few neurological side effects at ordinary clinical doses, and it does not significantly raise prolactin levels. Although it does not produce most of clozapine's most troubling side effects, including agranulocytosis, some patients taking olanzapine may become sedated or dizzy, develop dry mouth, or gain weight. In rare cases, liver function tests become transiently abnormal.

Outcome studies in schizophrenia are usually based on hospital treatment studies and may not be representative of the population of schizophrenia patients. At the extremes of outcome, 20% of patients seem to recover completely after one episode of psychosis, whereas 14–19% of patients develop a chronic unremitting psychosis and never fully recover. In general, clinical outcome at five years seems to follow the rule of thirds: with about 35% of patients in the poor outcome category; 36% in the good outcome category, and the remainder with intermediate outcome. Prognosis in schizophrenia does not seem to worsen after five years.

Whatever the reasons, there is increasing evidence that leaving schizophrenia untreated for long periods early in course of the illness may negatively affect the outcome. However, the use of drugs is often delayed for patients experiencing a first episode of the illness. The patients may not realize that they are ill, or they may be afraid to seek help; family members sometimes hope the problem will simply disappear or cannot persuade the patient to seek treatment; clinicians may hesitate to prescribe antipsychotic medications when the diagnosis is uncertain because of potential side effects. Indeed, at the first manifestation of the disease, schizophrenia is difficult to distinguish from bipolar manic-depressive disorders, severe depression, drug-related disorders, and stress-related disorders. Since the optimum treatments differ among these diseases, the long term prognosis of the disorder also differs the beginning of the treatment.

For both schizophrenia and bipolar disorder, all the known molecules used for the treatment of schizophrenia have side effects and act only against the symptoms of the disease. There is a strong need for new molecules without associated side effects and directed against targets which are involved in the causal mechanisms of schizophrenia and bipolar disorder. Therefore, tools facilitating the discovery and characterization of these targets are necessary and useful.

Schizophrenia and bipolar disorder are now considered to be brain diseases, and emphasis is placed on biological determinants in researching the conditions. In the case of schizophrenia, neuroimaging and neuropathological studies have shown evidence of brain abnormalities in schizophrenic patients. The timing of these pathological changes is unclear but are likely to be a defect in early brain development. Profound changes have also occurred in hypotheses concerning neurotransmitter abnormalities in schizophrenia. The dopamine hypothesis has been extensively revised and is no longer considered as a primary causative model.

The aggregation of schizophrenia and bipolar disorder in families, the evidence from twin and adoption studies, and the lack of variation in incidence worldwide, indicate that schizophrenia and bipolar disorder are primarily genetic conditions, although environmental risk factors are also involved at some level as necessary, sufficient, or interactive causes. For example, schizophrenia occurs in 1% of the general population. But, if there is one grandparent with schizophrenia, the risk of getting the illness increases to about 3%; one parent with Schizophrenia, to about 10%. When both parents have schizophrenia, the risk rises to approximately 40%.

Consequently, there is a strong need to identify genes involved in schizophrenia and bipolar disorder. The knowledge of these genes will allow researchers to understand the etiology of schizophrenia and bipolar disorder and could lead to drugs and medications which are directed against the cause of the diseases, not just against their symptoms.

There is also a great need for new methods for detecting a susceptibility to schizophrenia and bipolar disorder, as well as for preventing or following up the development of the disease. Diagnostic tools could also prove extremely useful. Indeed, early identification of subjects at risk of developing schizophrenia would enable early and/or prophylactic treatment to be administered. Moreover, accurate assessments of the eventual efficacy of a medicament as well as the patent's eventual tolerance to it may enable clinicians to enhance the benefit/risk ratio of schizophrenia and bipolar disorder treatment regimes.

SUMMARY OF THE INVENTION

The present invention stems from the identification of novel polymorphisms including biallelic markers located on the human chromosome 13q31-q33 locus, the identification and characterization of novel schizophrenia-related genes located on the human chromosome 13q31-q33 locus, and from the identification of genetic associations between alleles of biallelic markers located on the human chromosome 13q31-q33 locus and disease, as confirmed and characterized in a panel of human subjects. The invention furthermore provides a fine structure map of the region which includes the schizophrenia-associated gene sequences.

The present invention pertains to nucleic acid molecules comprising the genomic sequences of novel human genes encoding sbg1, g34665, sbg2, g35017 and g35018 proteins, proteins encoded thereby, as well as antibodies thereto. The sbg1, g34665, sbg2, g35017 and g35018 genomic sequences may also comprise regulatory sequence located upstream (5'-end) and downstream (3'-end) of the transcribed portion of said gene, these regulatory sequences being also part of the invention. The invention also deals with the cDNA sequence encoding the sbg1 and g35018 proteins.

Oligonucleotide probes or primers hybridizing specifically with a sbg1, g34665, sbg2, g35017 or g35018 genomic or cDNA sequence are also part of the present invention, as well as DNA amplification and detection methods using said primers and probes.

A further object of the invention consists of recombinant vectors comprising any of the nucleic acid sequences described above, and in particular of recombinant vectors comprising a sbg1, g34665, sbg2, g35017 or g35018 regulatory sequence or a sequence encoding a sbg1, g34665, sbg2, g35017 or g35018 protein, as well as of cell hosts and transgenic non human animals comprising said nucleic acid sequences or recombinant vectors.

The invention also concerns to biallelic markers of the sbg1, g34665, sbg2, g35017 or g35018 gene and the use thereof. Included are probes and primers for use in genotyping biallelic markers of the invention.

An embodiment of the invention encompasses any polynucleotide of the invention attached to a solid support polynucleotide may comprise a sequence disclosed in the present specification; optionally, said polynucleotide may comprise, consist of, or consist essentially of any polynucleotide described in the present specification; optionally, said determining may be performed in a hybridization assay, sequencing assay, microsequencing assay, or an enzyme-based mismatch detection assay; optionally, said polynucleotide may be attached to a solid support, array, or addressable array; optionally, said polynucleotide may be labeled.

Finally, the invention is directed to drug screening assays and methods for the screening of substances for the treatment of schizophrenia, bipolar disorder or a related CNS disorder based on the role of sbg1, g34665, sbg2, g35017 and g35018 nucleotides and polynucleotides in disease. One object of the invention deals with animal models of schizophrenia, including mouse, primate, non-human primate bipolar disorder or related CNS disorder based on the role of sbg1 in disease. The invention is also directed to methods for the screening of substances or molecules that inhibit the expression of sbg1, g34665, sbg2, g35017 or g35018, as well as with methods for the screening of substances or molecules that interact with a sbg1, g34665, sbg2, g35017 or g35018 polypeptide, or that modulate the activity of a sbg1, g34665, sbg2, g35017 or g35018 polypeptide.

As noted above, certain aspects of the present invention stem from the identification of genetic associations between schizophrenia and bipolar disorder and alleles of biallelic markers located on the human chromosome 13q31-q33 region, and more particularly on a subregion thereof referred to herein as Region D. The invention provides appropriate tools for establishing further genetic associations between alleles of biallelic markers on the 13q31-13q33 locus and either side effects or benefit resulting from the administration of agents acting on schizophrenia or bipolar disorder, or schizophrenia or bipolar disorder symptoms, including agents like chlorpromazine, clozapine, risperidone, olanzapine, sertindole, quetiapine and ziprasidone.

The invention provides appropriate tools for establishing further genetic associations between alleles of biallelic markers on the 13q31-13q33 locus and a trait. Methods and products are provided for the molecular detection of a genetic susceptibility in humans to schizophrenia and bipolar disorder. They can be used for diagnosis, staging, prognosis and monitoring of this disease, which processes can be further included within treatment approaches. The invention also provides for the efficient design and evaluation of suitable therapeutic solutions including individualized strategies for optimizing drug usage, and screening of potential new medicament candidates.

Additional embodiments are set forth in the Detailed Description of the Invention and in the Examples.

BRIEF DESCRIPTION OF THE FIGURES

FIG. 3 is a table demonstrating the results of a haplotype association analysis between total French Canadian schizophrenia cases and haplotypes which consist of chromosome 13q31-q33 biallelic markers of the invention.

FIG. 4 is a table showing the involvement of selected biallelic markers of the invention in statistically significant haplotypes.

FIG. 5 is a table demonstrating the results of a haplotype association analysis between French Canadian schizophrenia cases and haplotypes which consist of chromosome 13q31-q33 biallelic markers of the invention.

FIG. 6 is a table demonstrating the results of a haplotype association analysis between French Canadian schizophrenia cases and haplotypes which consist of chromosome 13q31-q33 biallelic markers of the invention.

FIGS. 7A and 7B show the results of a haplotype association analysis (Omnibus LR test value distribution) between schizophrenia cases and haplotypes comprising Region D biallelic markers of the invention.

FIG. 12 shows a comparison of the number of significant single and multipoint biallelic marker analyses in subregions D1 to D4 of Region D in French Canadian samples.

FIG. 13 shows a summary of the number of significant single and multipoint biallelic marker analyses across Region D in French Canadian samples.

FIG. 14 shows a comparison of the number of significant single and multipoint biallelic marker analyses in subregions D1 to D4 of Region D in United States schizophrenia samples.

FIG. 15 shows a summary of the number of significant single and multipoint biallelic marker analyses across Region D in United States schizophrenia samples.

FIG. 16 shows a comparison of the number of significant single and multipoint biallelic marker analyses in subregions D1 to D4 of Region D in Argentinian bipolar disorder samples.

FIG. 17 shows a summary of the number of significant single and multipoint biallelic marker analyses across Region D in Argentinian bipolar disorder samples.

BRIEF DESCRIPTION OF THE SEQUENCES PROVIDED IN THE SEQUENCE LISTING

Figure 1:
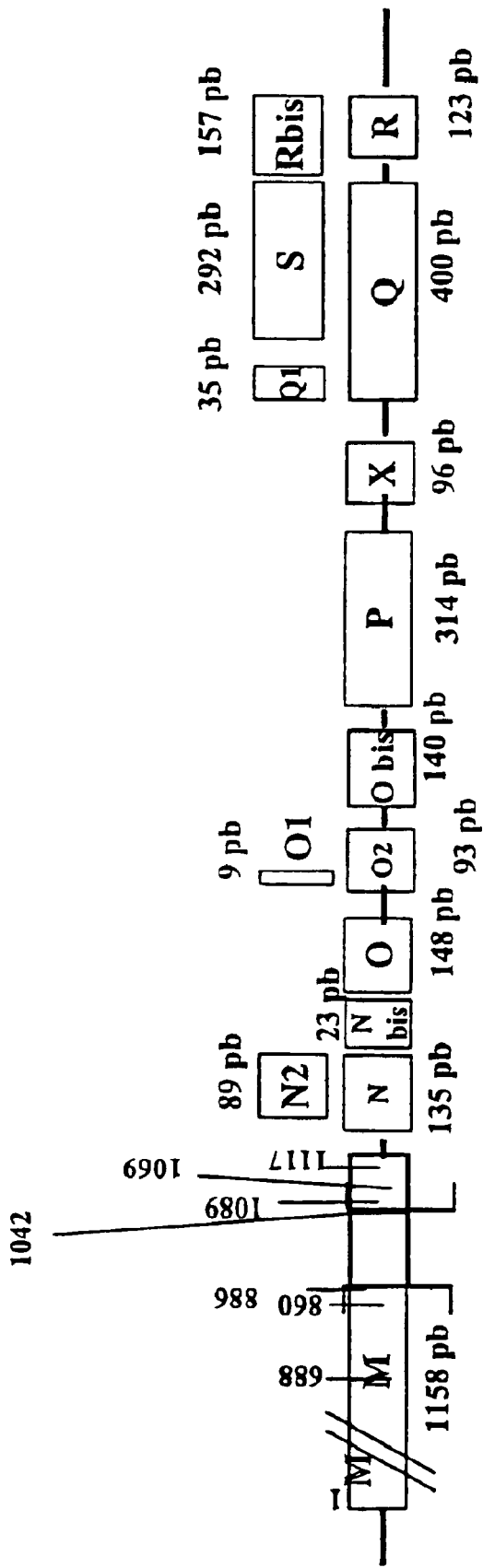
FIG. 1 is a diagram showing the exon structure of the sbg1 gene.

SEQ ID No. 1 contains the approximately 319 kb of genomic nucleotide sequence comprising sbg1, g34665, sbg2, g35017 and g35018 nucleic acid sequences and the biallelic markers A1 to A360 and polymorphisms A361 to A489 located on the human chromosome 13q31-q33 locus.

SEQ ID Nos. 2 to 26 contain cDNA sequences of the sbg1 gene.

SEQ ID Nos. 27 to 35 contain amino acid sequences of sbg1 polypeptides, encoded by cDNAs of SEQ ID Nos. 2 to 26.

SEQ ID No. 36 to 40 contain cDNA sequences of the g35018 gene

SEQ ID No. 41 to 43 contain amino acid sequences of an g35018 polypeptides.

SEQ ID No. 44 to 53 contain primers used to isolate sbg1 cDNAs

SEQ ID No. 54 to 111 contain genomic nucleotide sequences comprising exons of the sbg1 gene from several different primates.

SEQ ID Nos. 112 to 229 respectively contain the nucleotide sequence of the amplicons which comprise the biallelic markers A243 to A360 located on the human chromosome 13q31-q33 locus.

SEQ ID No 230 contains a primer containing the additional PU 5' sequence described further in Example 2.

SEQ ID No 231 contains a primer containing the additional RP 5' sequence described further in Example 2.

In accordance with the regulations relating to Sequence Listings, the following codes have been used in the Sequence Listing to indicate the locations of biallelic markers within the sequences and to identify each of the alleles present at the polymorphic base. The code "r" in the sequences indicates that one allele of the polymorphic base is a guanine, while the other allele is an adenine. The code "y" in the sequences indicates that one allele of the polymorphic base is a thymine, while the other allele is a cytosine. The code "m" in the sequences indicates that one allele of the polymorphic base is an adenine, while the other allele is an cytosine. The code "k" in the sequences indicates that one allele of the polymorphic base is a guanine, while the other allele is a thymine. The code "s" in the sequences indicates that one allele of the polymorphic base is a guanine, while the other allele is a cytosine. The code "w" in the sequences indicates that one allele of the polymorphic base is an adenine, while the other allele is an thymine.

DETAILED DESCRIPTION OF THE INVENTION

The identification of genes involved in a particular trait such as a specific central nervous system disorder, like schizophrenia, can be carried out through two main strategies currently used for genetic mapping: linkage analysis and association studies. Linkage analysis requires the study of families with multiple affected individuals and is now useful in the detection of mono- or oligogenic inherited traits. Conversely, association studies examine the frequency of marker alleles in unrelated trait (T+) individuals compared with trait negative (T−) controls, and are generally employed in the detection of polygenic inheritance.

Candidate Region on the Chromosome 13 (Linkage Analysis)

Genetic link or "linkage" is based on an analysis of which of two neighboring sequences on a chromosome contains the least recombinations by crossing-over during meiosis. To do this, chromosomal markers, like microsatellite markers, have been localized with precision on the genome. Genetic link analysis calculates the probabilities of recombinations on the target gene with the chromosomal markers used, according to the genealogical tree, the transmission of the disease, and the transmission of the markers. Thus, if a particular allele of a given marker is transmitted with the disease more often than chance would have it (recombination level between 0 and 0.5), it is possible to deduce that the target gene in question is found in the neighborhood of the marker.

Using this technique, it has been possible to localize several genes demonstrating a genetic predisposition of familial cancers. In order to be able to be included in a genetic link study, the families affected by a hereditary form of the disease must satisfy the "informativeness" criteria: several affected subjects (and whose constitutional DNA is available) per generation, and at best having a large number of siblings.

By linkage analysis, observations have been made, according to which a candidate region for schizophrenia is present on chromosome 13q32 locus (Blouin et al., 1998). Linkage analysis has been successfully applied to map simple genetic traits that show clear Mendelian inheritance patterns and which have a high penetrance, but this method suffers from a variety of drawbacks. First, linkage analysis is limited by its reliance on the choice of a genetic model suitable for each studied trait. Furthermore, the resolution attainable using linkage analysis is limited, and complementary studies are required to refine the analysis of the typical 20 Mb regions initially identified through this method. In addition, linkage analysis have proven difficult when applied to complex genetic traits, such as those due to the combined action of multiple genes and/or environmental factors. In such cases, too great an effort and cost are needed to recruit the adequate number of affected families required for applying linkage analysis to these situations. Finally, linkage analysis cannot be applied to the study of traits for which no large informative families are available.

In the present invention alternative means for conducting association studies rather than linkage analysis between markers located on the chromosome 13q31-q33 locus and a trait, preferably schizophrenia or bipolar disorder, are disclosed.

In the present application, additional biallelic markers located on the human chromosome 13q31-q33 locus associated with schizophrenia are disclosed. The identification of these biallelic markers in association with schizophrenia has allowed for the further definition of the chromosomal region suspected of containing a genetic determinant involved in a predisposition to develop schizophrenia and has resulted in the identification of novel gene sequences disclosed herein which are associated with a predisposition to develop schizophrenia. The present invention thus provides an extensive fine structure map of the 13q31-q33 locus, including novel biallelic markers located on the human 13q31-q33 locus, approximately 319 kb of genomic nucleotide sequence of a subregion of the human 13q31-q33 locus, and polymorphisms including biallelic markers and nucleotide deletions in said 319 kb genomic sequence. The biallelic markers of the human chromosome 13q31-q33 locus and the nucleotide sequences, polymorphisms and gene sequences located in Region D subregion of the human chromosome 13q31-q33 locus are useful as genetic and physical markers for further mapping studies. The approximately 319 kb of genomic nucleotide sequence disclosed herein can further serve as a reference in genetic or physical analysis of deletions, substitutions, and insertions in that region. Additionally, the sequence information provides a resource for the further identification of new genes in that region. Additionally, the sequences comprising the schizophrenia-associated genes are useful, for example, for the isolation of other genes in putative gene families, the identification of homologs from other species, treatment of disease and as probes and primers for diagnostic or screening assays as described herein.

These identified polymorphisms are used in the design of assays for the reliable detection of genetic susceptibility to schizophrenia and bipolar disorder. They can also be used in the design of drug screening protocols to provide an accurate and efficient evaluation of the therapeutic and side-effect potential of new or already existing medicament or treatment regime.

Definitions

As used interchangeably herein, the term "oligonucleotides", and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064, the disclosure of which is incorporated herein by reference. However, the polynucleotides of the invention are preferably comprised of greater than 50% conventional deoxyribose nucleotides, and most preferably greater than 90% conventional deoxyribose nucleotides. The polynucleotide sequences of the invention may be prepared by any known method, including synthetic, recombinant, ex vivo generation, or a combination thereof, as well as utilizing any purification methods known in the art.

The term "purified" is used herein to describe a polynucleotide or polynucleotide vector of the invention which has been separated from other compounds including, but not limited to other nucleic acids, carbohydrates, lipids and proteins (such as the enzymes used in the synthesis of the polynucleotide), or the separation of covalently closed polynucleotides from linear polynucleotides. A polynucleotide is substantially pure when at least about 50%, preferably 60 to 75% of a sample exhibits a single polynucleotide sequence and conformation (linear versus covalently close). A substantially pure polynucleotide typically comprises about 50%, preferably 60 to 90% weight/weight of a nucleic acid sample, more usually about 95%, and preferably is over about 99% pure. Polynucleotide purity or homogeneity may be indicated by a number of means well known in the art, such as agarose or polyacrylamide gel electrophoresis of a sample, followed by visualizing a single polynucleotide band upon staining the gel. For certain purposes higher resolution can be provided by using HPLC or other means well known in the art.

The term "isolated" requires that the material be removed from its original environment (e.g., the natural environment if it is naturally occurring). For example, a naturally-occurring polynucleotide or polypeptide present in a living animal is not isolated, but the same polynucleotide or DNA or polypeptide, separated from some or all of the coexisting materials in the natural system, is isolated. Such polynucleotide could be part of a vector and/or such polynucleotide or polypeptide could be part of a composition, and still be isolated in that the vector or composition is not part of its natural environment.

The term "primer" denotes a specific oligonucleotide sequence which is complementary to a target nucleotide sequence and used to hybridize to the target nucleotide sequence. A primer serves as an initiation point for nucleotide polymerization catalyzed by either DNA polymerase, RNA polymerase or reverse transcriptase.

The term "probe" denotes a defined nucleic acid segment (or nucleotide analog segment, e.g., polynucleotide as defined herein) which can be used to identify a specific polynucleotide sequence present in samples, said nucleic acid segment comprising a nucleotide sequence complementary of the specific polynucleotide sequence to be identified.

The terms "trait" and "phenotype" are used interchangeably herein and refer to any clinically distinguishable, detectable or otherwise measurable property of an organism such as symptoms of, or susceptibility to a disease for example. Typically the terms "trait" or "phenotype" are used herein to refer to symptoms of, or susceptibility to schizophrenia or bipolar disorder; or to refer to an individual's response to an agent acting on schizophrenia or bipolar disorder; or to refer to symptoms of, or susceptibility to side effects to an agent acting on schizophrenia or bipolar disorder.

The term "allele" is used herein to refer to variants of a nucleotide sequence. A biallelic polymorphism has two forms. Typically the first identified allele is designated as the original allele whereas other alleles are designated as alternative alleles. Diploid organisms may be homozygous or heterozygous for an allelic form.

The term "heterozygosity rate" is used herein to refer to the incidence of individuals in a population, which are heterozygous at a particular allele. In a biallelic system the heterozygosity rate is on average equal to $2P_a(1-P_a)$, where $P_a$ is the frequency of the least common allele. In order to be useful in genetic studies a genetic marker should have an adequate level of heterozygosity to allow a reasonable probability that a randomly selected person will be heterozygous.

The term "genotype" as used herein refers the identity of the alleles present in an individual or a sample. In the context of the present invention a genotype preferably refers to the description of the biallelic marker alleles present in an individual or a sample. The term "genotyping" a sample or an individual for a biallelic marker involves determining the specific allele or the specific nucleotide(s) carried by an individual at a biallelic marker.

The term "mutation" as used herein refers to a difference in DNA sequence between or among different genomes or individuals which has a frequency below 1%.

The term "haplotype" refers to a combination of alleles present in an individual or a sample on a single chromosome. In the context of the present invention a haplotype preferably refers to a combination of biallelic marker alleles found in a given individual and which may be associated with a phenotype.

The term "polymorphism" as used herein refers to the occurrence of two or more alternative genomic sequences or alleles between or among different genomes or individuals. "Polymorphic" refers to the condition in which two or more variants of a specific genomic sequence can be found in a population. A "polymorphic site" is the locus at which the variation occurs. A polymorphism may comprise a substitution, deletion or insertion of one or more nucleotides. A single nucleotide polymorphism is a single base pair change. Typically a single nucleotide polymorphism is the replacement of one nucleotide by another nucleotide at the polymorphic site. Deletion of a single nucleotide or insertion of a single nucleotide, also give rise to single nucleotide polymorphisms. In the context of the present invention "single nucleotide polymorphism" preferably refers to a single nucleotide substitution. Typically, between different genomes or between different individuals, the polymorphic site may be occupied by two different nucleotides.

The terms "biallelic polymorphism" and "biallelic marker" are used interchangeably herein to refer to a polymorphism having two alleles at a fairly high frequency in the population, preferably a single nucleotide polymorphism. A "biallelic marker allele" refers to the nucleotide variants present at a biallelic marker site. Typically the frequency of the less common allele of the biallelic markers of the present invention has been validated to be greater than 1%, preferably the frequency is greater than 10%, more preferably the frequency is at least 20% (i.e. heterozygosity rate of at least 0.32), even more preferably the frequency is at least 30% (i.e. heterozygosity rate of at least 0.42). A biallelic marker wherein the frequency of the less common allele is 30% or more is termed a "high quality biallelic marker." All of the genotyping, haplotyping, association, and interaction study methods of the invention may optionally be performed solely with high quality biallelic markers.

The location of nucleotides in a polynucleotide with respect to the center of the polynucleotide are described herein in the following manner. When a polynucleotide has an odd number of nucleotides, the nucleotide at an equal distance from the 3' and 5' ends of the polynucleotide is considered to be "at the center" of the polynucleotide, and any nucleotide immediately adjacent to the nucleotide at the center, or the nucleotide at the center itself is considered to be "within 1 nucleotide of the center." With an odd number of nucleotides in a polynucleotide any of the five nucleotides positions in the middle of the polynucleotide would be considered to be within 2 nucleotides of the center, and so on. When a polynucleotide has an even number of nucleotides, there would be a bond and not a nucleotide at the center of the polynucleotide. Thus, either of the two central nucleotides would be considered to be "within 1 nucleotide of the center" and any of the four nucleotides in the middle of the polynucleotide would be considered to be "within 2 nucleotides of the center", and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on.

The term "upstream" is used herein to refer to a location which, is toward the 5' end of the polynucleotide from a specific reference point.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry*, 4th edition, 1995).

The terms "complementary" or "complement thereof" are used herein to refer to the sequences of polynucleotides which is capable of forming Watson & Crick base pairing with another specified polynucleotide throughout the entirety of the complementary region. This term is applied to pairs of polynucleotides based solely upon their sequences and not any particular set of conditions under which the two polynucleotides would actually bind.

The terms "sbg1 gene", when used herein, encompasses genomic, mRNA and cDNA sequences encoding the sbg1 protein, including the untranslated regulatory regions of the genomic DNA.

The terms "g34665 gene", when used herein, encompasses genomic, mRNA and cDNA sequences encoding the g34665 protein, including the untranslated regulatory regions of the genomic DNA.

The terms "sbg2 gene", when used herein, encompasses genomic, mRNA and cDNA sequences encoding the sbg2 protein, including the untranslated regulatory regions of the genomic DNA.

The terms "g35017 gene", when used herein, encompasses genomic, mRNA and cDNA sequences encoding the g35017 protein, including the untranslated regulatory regions of the genomic DNA.

The terms "g35018 gene", when used herein, encompasses genomic, mRNA and cDNA sequences encoding the g35018 protein, including the untranslated regulatory regions of the genomic DNA.

As used herein the term "13q31-q33-related biallelic marker" relates to a set of biallelic markers residing in the human chromosome 13q31-q33 region. The term 13q31-q33-related biallelic marker encompasses all of the biallelic markers disclosed in Table 6b and any biallelic markers in linkage disequilibrium therewith, as well as any biallelic markers disclosed in Table 6c and any biallelic markers in linkage disequilibrium therewith. The preferred chromosome 13q31-q33-related biallelic marker alleles of the present invention include each one the alleles described in Tables 6b individually or in groups consisting of all the possible combinations of the alleles listed.

As used herein the term "Region D-related biallelic marker" relates to a set of biallelic markers in linkage disequilibrium with the subregion of the chromosome 13q31-q33 region referred to herein as Region D. The term Region D-related biallelic marker encompasses the biallelic markers A1 to A242, A249 to A251, A257 to A263, A269 to A270, A278, A285 to A299, A303 to A307, A324, A330, A334 to A335, A346 to A357 and A361 to A489 disclosed in Table 6b and any biallelic markers in linkage disequilibrium with markers A1 to A242, A249 to A251, A257 to A263, A269 to A270, A278, A285 to A299, A303 to A307, A324, A334 to A335, A346 to A357 and A361 to A489.

As used herein the term "sbg1-related biallelic marker" relates to a set of biallelic markers in linkage disequilibrium with the sbg1 gene or an sbg1 nucleotide sequence. The term sbg1-related biallelic marker encompasses the biallelic markers A85 to A219 disclosed in Table 6b and any biallelic markers in linkage disequilibrium therewith.

As used herein the term "g34665-related biallelic marker" relates to a set of biallelic markers in linkage disequilibrium with the g34665 gene or an sbg1 nucleotide sequence. The term g34665-related biallelic marker encompasses the biallelic markers A230 to A236 disclosed in Table 6b and any biallelic markers in linkage disequilibrium therewith.

As used herein the term "sbg2-related biallelic marker" relates to a set of biallelic markers in linkage disequilibrium with the sbg2 gene or an sbg2 nucleotide sequence. The term sbg2-related biallelic marker encompasses the biallelic markers A79 to A99 disclosed in Table 6b and any biallelic markers in linkage disequilibrium therewith.

As used herein the term "g35017-related biallelic marker" relates to a set of biallelic markers in linkage disequilibrium with the g35017 gene or an g35017 nucleotide sequence. The term g35017-related biallelic marker encompasses biallelic marker A41 disclosed in Table 6b and any biallelic markers in linkage disequilibrium therewith.

As used herein the term "g35018-related biallelic marker" relates to a set of biallelic markers in linkage disequilibrium with the g35018 gene or a g35018 nucleotide sequence. The term g35018-related biallelic marker encompasses the biallelic markers A1 to A39 disclosed in Table 6b and any biallelic markers in linkage disequilibrium therewith.

The term "polypeptide" refers to a polymer of amino acids without regard to the length of the polymer; thus, peptides, oligopeptides, and proteins are included within the definition of polypeptide. This term also does not specify or exclude prost-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

The term "purified" is used herein to describe a polypeptide of the invention which has been separated from other compounds including, but not limited to nucleic acids, lipids, carbohydrates and other proteins. A polypeptide is substantially pure when at least about 50%, preferably 60 to 75% of a sample exhibits a single polypeptide sequence. A substantially pure polypeptide typically comprises about 50%, preferably 60 to 90% weight/weight of a protein sample, more usually about 95%, and preferably is over about 99% pure. Polypeptide purity or homogeneity is indicated by a number of means well known in the art, such as agarose or polyacrylamide gel electrophoresis of a sample, followed by visualizing a single polypeptide band upon staining the gel. For certain purposes higher resolution can be provided by using HPLC or other means well known in the art.

As used herein, the term "non-human animal" refers to any non-human vertebrate, birds and more usually mammals, preferably primates, farm animals such as swine, goats, sheep, donkeys, and horses, rabbits or rodents, more preferably rats or mice. As used herein, the term "animal" is used to refer to any vertebrate, preferable a mammal. Both the terms "animal" and "mammal" expressly embrace human subjects unless preceded with the term "non-human".

As used herein, the term "antibody" refers to a polypeptide or group of polypeptides which are comprised of at least one binding domain, where an antibody binding domain is formed from the folding of variable domains of an antibody molecule to form three-dimensional binding spaces with an internal surface shape and charge distribution complementary to the features of an antigenic determinant of an antigen., which allows an immunological reaction with the antigen. Antibodies include recombinant proteins comprising the binding domains, as wells as fragments, including Fab, Fab', $F(ab)_2$, and $F(ab')_2$ fragments.

As used herein, an "antigenic determinant" is the portion of an antigen molecule, in this case an sbg1 polypeptide, that determines the specificity of the antigen-antibody reaction. An "epitope" refers to an antigenic determinant of a polypeptide. An epitope can comprise as few as 3 amino acids in a spatial conformation which is unique to the epitope. Generally an epitope comprises at least 6 such amino acids, and more usually at least 8–10 such amino acids. Methods for determining the amino acids which make up an epitope include x-ray crystallography, 2-dimensional nuclear magnetic resonance, and epitope mapping e.g. the Pepscan method described by Geysen et al. 1984; PCT Publication No. WO 84/03564; and PCT Publication No. WO 84/03506.

Variants and Fragments

The invention also relates to variants and fragments of the polynucleotides described herein, particularly of a nucleotide sequence of SEQ ID Nos. 1 to 26, 36 to 40 and 54 to 229, and particularly of a nucleotide sequence of SEQ ID Nos. 1 to 26, 36 to 40 and 54 to 229 containing one or more biallelic markers and/or other polymorphisms according to the invention.

Variants of polynucleotides, as the term is used herein, are polynucleotides that differ from a reference polynucleotide. A variant of a polynucleotide may be a naturally occurring variant such as a naturally occurring allelic variant, or it may be a variant that is not known to occur naturally. Such non-naturally occurring variants of the polynucleotide may be made by mutagenesis techniques, including those applied to polynucleotides, cells or organisms. Generally, differences are limited so that the nucleotide sequences of the reference and the variant are closely similar overall and, in many regions, identical.

Variants of polynucleotides according to the invention include, without being limited to, nucleotide sequences which are at least 95% identical to a polynucleotide selected from the group consisting of the nucleotide sequences SEQ ID Nos. 1 to 26, 36 to 40 and 54 to 229 or to any polynucleotide fragment of at least 8 consecutive nucleotides of a polynucleotide selected from the group consisting of the nucleotide SEQ ID Nos. 1 to 26, 36 to 40 and 54 to 229, and preferably at least 99% identical, more particularly at least 99.5% identical, and most preferably at least 99.8% identical to a polynucleotide selected from the group consisting of the nucleotide SEQ ID Nos. 1 to 26, 36 to 40 and 54 to 229 or to any polynucleotide fragment of at least 30, 35, 40, 50, 70, 80, 100, 250, 500, 1000 or 2000, to the extent that the length is consistent with the particular sequence ID, consecutive nucleotides of a polynucleotide selected from the group consisting of the nucleotide sequences of SEQ ID Nos. 1 to 26, 36 to 40 and 54 to 229.

Nucleotide changes present in a variant polynucleotide may be silent, which means that they do not alter the amino acids encoded by the polynucleotide. However, nucleotide changes may also result in amino acid substitutions, additions, deletions, fusions and truncations in the polypeptide encoded by the reference sequence. The substitutions, deletions or additions may involve one or more nucleotides. The variants may be altered in coding or non-coding regions or both. Alterations in the coding regions may produce conservative or non-conservative amino acid substitutions, deletions or additions.

A polynucleotide fragment is a polynucleotide having a sequence that is entirely the same as part but not all of a given nucleotide sequence, preferably the nucleotide sequence of an sbg1 polynucleotide, and variants thereof, or of a polynucleotide of any of SEQ ID Nos 1 to 26, 36 to 40 and 54 to 229, or a polynucleotide comprising one of the biallelic markers A1 to A360 or polymorphism A361 to A489, or the complements thereof. Such fragments may be "free-standing", i.e. not part of or fused to other polynucleotides, or they may be comprised within a single larger polynucleotide of which they form a part or region. Indeed, several of these fragments may be present within a single larger polynucleotide. Optionally, such fragments may comprise, consist of, or consist essentially of a contiguous span of at least 8, 10, 12, 15, 18, 20, 25, 30, 35, 40, 50, 70, 80, 100, 250, 500, 1000 or 2000 nucleotides in length of any of SEQ ID Nos 1 to 26, 36 to 40 and 54 to 229.

Identity Between Nucleic Acids or Polypeptides

The terms "percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Homology is evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, Proc. Natl. Acad. Sci. USA 85(8):2444–2448; Altschul et al., 1990, J. Mol. Biol. 215(3):403–410; Thompson et al., 1994, Nucleic Acids Res. 22(2):4673–4680; Higgins et al. 1996, Methods Enzymol. 266:383–402; Altschul et al., 1990, J. Mol. Biol. 215(3):403–410; Altschul et al., 1993, Nature Genetics 3:266–272). In a particularly preferred embodiment, protein and nucleic acid sequence homologies are evaluated using the Basic Local Alignment Search Tool ("BLAST") which is well known in the art (see, e.g., Karlin and Altschul, 1990, Proc. Natl. Acad. Sci. USA 87:2267–2268; Altschul et al., 1990, J. Mol. Biol. 215:403–410; Altschul et al., 1993, Nature Genetics 3:266–272; Altschul et al., 1997, Nuc. Acids Res. 25:3389–3402). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, Science 256:1443–1445; Henikoff and Henikoff, 1993, Proteins 17:49–61). Less preferably, the PAM or PAM250 matrices may also be used (see, e.g., Schwartz and Dayhoff, eds., 1978, Matrices for Detecting Distance Relationships: Atlas of Protein Sequence and Structure, Washington: National Biomedical Research Foundation). The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, Proc. Natl. Acad. Sci. USA 87:2267–2268).

The BLAST programs may be used with the default parameters or with modified parameters provided by the user.

Stringent Hybridization Conditions

By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20× $10^6$ of $^{32}$P-labeled probe. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Following the wash steps, the hybridized probes are detectable by autoradiography. Other conditions of high stringency which may be used are well known in the art and as cited in Sambrook et al., 1989; and Ausubel et al., 1989, are incorporated herein in their entirety. These hybridization conditions are suitable for a nucleic acid molecule of about 20 nucleotides in length. There is no need to say that the hybridization conditions described above are to be adapted according to the length of the desired nucleic acid, following techniques well known to the one skilled in the art. The suitable hybridization conditions may for example be adapted according to the teachings disclosed in the book of Hames and Higgins (1985) or in Sambrook et al. (1989).

Genomic Sequences of the Polynucleotides of the Invention

The present invention concerns genomic DNA sequences of the sbg1, g34665, sbg2, g35017 and g35018 genes, as well as DNA sequences of the human chromosome 13q31-q33 region, and more particularly, a subregion thereof referred to herein as region D.

As referred to herein, genomic sequences of sbg2, g35017 and g35018 are indicated by nucleotide position in the 5' to 3' orientation on SEQ ID No 1. sbg1 and g34665 are transcribed in the opposite direction, i.e. from the nucleic acid strand complementary to SEQ ID No 1. Genomic sequences of sbg1 and g34665 are thus indicated by nucleotide position in the 3' to 5' orientation on SEQ ID No 1.

Preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides of nucleotide positions 31 to 292651 and 292844 to 319608 of SEQ ID No. 1, or the complements thereof. Further nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides, to the extent that the length of said span is consistent with the length of the SEQ ID, of SEQ ID Nos. 112 to 229. Optionally, said span is at least 12, 15, 18, 20, 25, 30, 35, 40, 50, 60, 70, 80, 90, 100, 150, 200, 500, 1000 or 2000 nucleotides of SEQ ID Nos. 112 to 114, 115 to 117, 119, 121, 125 to 145, 147 to 150, 159 to 170, and 176 to 229.

Additional preferred nucleic acids of the invention include isolated, purified, or recombinant polynucleotides comprising a contiguous span of at least 12, 15, 18, 20, 25, 30, 35, 40, 45, 50, 55, 60, 65, 70, 75, 80, 90, 100 or 200 nucleotides of SEQ ID No 1 or the complements thereof, wherein said contiguous span comprises a biallelic marker. Optionally, said contiguous span comprises ar biallelic marker selected from the group consisting of A1 to A69, A71 to A74, A76 to A94, A96 to A106, A108 to A112, A114 to A177, A197, A199 to A222, A224 to A242. Optionally allele 2 is present at the biallelic marker. It should be noted that nucleic acid fragments of any size and sequence may be comprised by the polynucleotides described in this section.

Another particularly preferred set of nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides, to the extent that such a length is consistent with the lengths of the particular nucleotide position, of SEQ ID No. 1 or the complements thereof, wherein said contiguous span comprises at least 1, 2, 3, 5, or 10 nucleotide positions of any one of the following ranges of nucleotide positions, designated pos1 to pos166, of SEQ ID No. 1 listed in Table 1 below:

TABLE 1

| Position | Position in SEQ ID No 1 | |
|---|---|---|
|  | Begining | End |
| pos 1 | 36 | 2000 |
| pos 2 | 2001 | 4000 |
| pos 3 | 4001 | 6000 |
| pos 4 | 6001 | 8000 |

TABLE 1-continued

| Position | Position in SEQ ID No 1 | |
|---|---|---|
|  | Begining | End |
| pos 5 | 8001 | 10000 |
| pos 6 | 10001 | 12000 |
| pos 7 | 12001 | 14000 |
| pos 8 | 14001 | 16000 |
| pos 9 | 16001 | 18000 |
| pos 10 | 18001 | 20000 |
| pos 11 | 20001 | 22000 |
| pos 12 | 22001 | 24000 |
| pos 13 | 24001 | 26000 |
| pos 14 | 26001 | 28000 |
| pos 15 | 28001 | 29966 |
| pos 16 | 30116 | 32000 |
| pos 17 | 32001 | 34000 |
| pos 18 | 34001 | 36000 |
| pos 19 | 36001 | 38000 |
| pos 20 | 38001 | 40000 |
| pos 21 | 40001 | 42000 |
| pos 22 | 42001 | 44000 |
| pos 23 | 44001 | 46000 |
| pos 24 | 46001 | 48000 |
| pos 25 | 48001 | 50000 |
| pos 26 | 50001 | 52000 |
| pos 27 | 52001 | 54000 |
| pos 28 | 54001 | 56000 |
| pos 29 | 56001 | 58000 |
| pos 30 | 58001 | 60000 |
| pos 31 | 60001 | 62000 |
| pos 32 | 62001 | 64000 |
| pos 33 | 64001 | 66000 |
| pos 34 | 66001 | 68000 |
| pos 35 | 68001 | 70000 |
| pos 36 | 70001 | 72000 |
| pos 37 | 72001 | 74000 |
| pos 38 | 74001 | 76000 |
| pos 39 | 76001 | 78000 |
| pos 40 | 78001 | 80000 |
| pos 41 | 80001 | 82000 |
| pos 42 | 82001 | 84000 |
| pos 43 | 84001 | 86000 |
| pos 44 | 86001 | 88000 |
| pos 45 | 88001 | 90000 |
| pos 46 | 90001 | 92000 |
| pos 47 | 92001 | 94000 |
| pos 48 | 94001 | 96000 |
| pos 49 | 96001 | 98000 |
| pos 50 | 98001 | 100000 |
| pos 51 | 10000 | 102000 |
| pos 52 | 10200 | 104000 |
| pos 53 | 10400 | 106000 |
| pos 54 | 10600 | 108000 |
| pos 55 | 10800 | 110000 |
| pos 56 | 11000 | 102000 |
| pos 57 | 10200 | 104000 |
| pos 58 | 10400 | 106000 |
| pos 59 | 10600 | 108000 |
| pos 60 | 10800 | 110000 |
| pos 61 | 11000 | 112000 |
| pos 62 | 11200 | 114000 |
| pos 63 | 11400 | 116000 |
| pos 64 | 11600 | 118000 |
| pos 65 | 11800 | 120000 |
| pos 66 | 12000 | 122000 |
| pos 67 | 12200 | 124000 |
| pos 68 | 12400 | 126000 |
| pos 69 | 12600 | 128000 |
| pos 70 | 12800 | 130000 |
| pos 71 | 13000 | 132000 |
| pos 72 | 13200 | 134000 |
| pos 73 | 13400 | 136000 |
| pos 74 | 13600 | 138000 |
| pos 75 | 13800 | 140000 |
| pos 76 | 14000 | 142000 |
| pos 77 | 14200 | 144000 |
| pos 78 | 14400 | 146000 |

TABLE 1-continued

| Position | Position in SEQ ID No 1 Begining | End |
|---|---|---|
| pos 79 | 14600 | 148000 |
| pos 80 | 148000 | 150000 |
| pos 81 | 150001 | 152000 |
| pos 82 | 152001 | 154000 |
| pos 83 | 154001 | 156000 |
| pos 84 | 156001 | 158000 |
| pos 85 | 158001 | 160000 |
| pos 86 | 160001 | 162000 |
| pos 87 | 162001 | 164000 |
| pos 88 | 164001 | 166000 |
| pos 89 | 166001 | 168000 |
| pos 90 | 168001 | 170000 |
| pos 91 | 170001 | 172000 |
| pos 92 | 172001 | 174000 |
| pos 93 | 174001 | 176000 |
| pos 94 | 176001 | 178000 |
| pos 95 | 178001 | 180000 |
| pos 96 | 180001 | 182000 |
| pos 97 | 182001 | 184000 |
| pos 98 | 184001 | 186000 |
| pos 99 | 186001 | 188000 |
| pos 100 | 188001 | 190000 |
| pos 101 | 190001 | 192000 |
| pos 102 | 192001 | 194000 |
| pos 103 | 194001 | 196000 |
| pos 104 | 196001 | 198000 |
| pos 105 | 198001 | 200000 |
| pos 106 | 200001 | 201000 |
| pos 107 | 201001 | 202000 |
| pos 108 | 202001 | 204000 |
| pos 109 | 204001 | 206000 |
| pos 110 | 206001 | 208000 |
| pos 111 | 208001 | 210000 |
| pos 112 | 210001 | 212000 |
| pos 113 | 212001 | 214000 |
| pos 114 | 214001 | 216000 |
| pos 115 | 216001 | 218000 |
| pos 116 | 218001 | 220000 |
| pos 117 | 220001 | 222000 |
| pos 118 | 222001 | 224000 |
| pos 119 | 224001 | 226000 |
| pos 120 | 226001 | 228000 |
| pos 121 | 228001 | 230000 |
| pos 122 | 230001 | 232000 |
| pos 123 | 232001 | 234000 |
| pos 124 | 234001 | 236000 |
| pos 125 | 236001 | 238000 |
| pos 126 | 238001 | 240000 |
| pos 127 | 240001 | 242000 |
| pos 128 | 242001 | 244000 |
| pos 129 | 244001 | 246000 |
| pos 130 | 246001 | 248000 |
| pos 131 | 248001 | 250000 |
| pos 132 | 250001 | 252000 |
| pos 133 | 252001 | 254000 |
| pos 134 | 254001 | 256000 |
| pos 135 | 256001 | 258000 |
| pos 136 | 258001 | 260000 |
| pos 137 | 260001 | 262000 |
| pos 138 | 262001 | 264000 |
| pos 139 | 264001 | 266000 |
| pos 140 | 266001 | 268000 |
| pos 141 | 268001 | 270000 |
| pos 142 | 270001 | 272000 |
| pos 143 | 272001 | 274000 |
| pos 144 | 274001 | 276000 |
| pos 145 | 276001 | 278000 |
| pos 146 | 278001 | 280000 |
| pos 147 | 280001 | 282000 |
| pos 148 | 282001 | 284000 |
| pos 149 | 284001 | 286000 |
| pos 150 | 286001 | 288000 |
| pos 151 | 288001 | 290000 |
| pos 152 | 290001 | 292000 |
| pos 153 | 292001 | 294000 |
| pos 154 | 294001 | 296000 |
| pos 155 | 296001 | 298000 |
| pos 156 | 298001 | 300000 |
| pos 157 | 300001 | 302000 |
| pos 158 | 302001 | 304000 |
| pos 159 | 304001 | 306000 |
| pos 160 | 306001 | 308000 |
| pos 161 | 308001 | 310000 |
| pos 162 | 310001 | 312000 |
| pos 163 | 312001 | 314000 |
| pos 164 | 314001 | 316000 |
| pos 165 | 316001 | 318000 |
| pos 166 | 318001 | 319608 |

Nucleic Acid Sequences of sbg1, g34665, sbg2, g35017 and g35018

The present invention encompasses the g34665, g34673, g34667, g35017 and g35018 genes and nucleotide sequences.

g34665

In one aspect, the invention concerns g34665 genomic sequences consisting of, consisting essentially of, or comprising the sequence of nucleotide positions 292653 to 296047 of SEQ ID No 1, a sequence complementary thereto, as well as fragments and variants thereof. These polynucleotides may be purified, isolated, or recombinant.

Particularly preferred nucleic acids of the invention include isolated, purified, or recombinant polynucleotides comprising a contiguous span of at least 12, 15, 18, 20, 25, 30, 35, 40, 50, 60, 70, 80, 90, 100, 150 or 200 nucleotides, to the extent that the length of said span is consistent with the nucleotide position range, of nucleotide positions 292653 to 292841, 295555 to 296047 or 295580 to 296047 of SEQ ID No 1. Further preferred nucleic acids of the invention include isolated, purified, or recombinant polynucleotides comprising a contiguous span of at least 12, 15, 18, 20, 25, 30, 35, 40, 50, 60, 70, 80, 90, 100, 150 or 200 nucleotides, to the extent that the length of said span is consistent with the nucleotide position range, of nucleotide positions 292653 to 292841, 295555 to 296047, or 295580 to 296047 of SEQ ID No 1, or the complements thereof, wherein said contiguous span comprises a g34665-related biallelic marker. Optionally, said biallelic marker is selected from the group consisting of A230 to A236. It should be noted that nucleic acid fragments of any size and sequence may also be comprised by the polynucleotides described in this section.

The invention also encompasses a purified, isolated, or recombinant polynucleotide comprising a nucleotide sequence having at least 70, 75, 80, 85, 90, 95, 97, 98 or 99% nucleotide identity with a nucleotide sequence of nucleotide positions 290653 to 292652, 292653 to 296047, 292653 to 292841, 295555 to 296047, 295580 to 296047 and 296048 to 298048 of SEQ ID No 1 or a complementary sequence thereto or a fragment thereof. The nucleotide differences as regards to nucleotide positions 290652 to 292652, 292653 to 296047, 292653 to 292841, 295555 to 296047, 295580 to 296047 and 296048 to 298048 of SEQ ID No 1 may be generally randomly distributed throughout the entire nucleic acid. Nevertheless, preferred nucleic acids are those wherein the nucleotide differences as regards to the nucleotide sequence of SEQ ID No 1 are predominantly located outside the coding sequences contained in the exons. These nucleic acids, as well as their fragments and variants, may be used as oligonucleotide primers or probes in order to detect the presence of a copy of the g34665 gene in a test sample, or alternatively in order to amplify a target nucleotide sequence within the g34665 sequences.

Another object of the invention consists of a purified, isolated, or recombinant nucleic acid that hybridizes with a g34665 nucleotide sequence of any of nucleotide positions 292653 to 296047, 292653 to 292841, 295555 to 296047, 295980 to 296047 and 296048 to 298048 SEQ ID No 1 or a complementary sequence thereto or a variant thereof, under the stringent hybridization conditions as defined above.

The g34665 genomic nucleic acid comprises at least 3 exons. The exon positions in SEQ ID No 1 are detailed below in Table 2.

TABLE 2

| | Position in SEQ ID No 1 | | | Position in SEQ ID No 1 | |
|---|---|---|---|---|---|
| Exon | Beginning | End | Intron | Beginning | End |
| B | 292653 | 292841 | B-Ab | 292842 | 295554 |
| Ab | 295555 | 296047 | B-A | 292842 | 295979 |
| A | 295980 | 296047 | | | |

Thus, the invention embodies purified, isolated, or recombinant polynucleotides comprising a nucleotide sequence selected from the group consisting of the 3 exons of the g34665 gene, or a sequence complementary thereto. The invention also deals with purified, isolated, or recombinant nucleic acids comprising a combination of two exons of the g34665 gene.

Intron B-Ab refers to the nucleotide sequence located between Exon B and Exon Ab, and so on. The position of the introns is detailed in Table 2. Thus, the invention embodies purified, isolated, or recombinant polynucleotides comprising a nucleotide sequence selected from the group consisting of the 2 introns of the g34665 gene, or a sequence complementary thereto.

While this section is entitled "Genomic Sequences of g34665," it should be noted that nucleic acid fragments of any size and sequence may also be comprised by the polynucleotides described in this section, flanking the genomic sequences of g34665 on either side or between two or more such genomic sequences.

A g34665 polynucleotide or gene may further contain regulatory sequences both in the non-coding 5'-flanking region and in the non-coding 3'-flanking region that border the region containing said genes or exons.

Polynucleotides derived from 5' and 3' regulatory regions are useful in order to detect the presence of at least a copy of a nucleotide sequence comprising a g34665 nucleotide sequence of SEQ ID No. 1 or a fragment thereof in a test sample. Polynucleotides carrying the regulatory elements located at the 5' end and at the 3' end of the genes comprising the exons of the present invention may be advantageously used to control the transcriptional and translational activity of a heterologous polynucleotide of interest.

Methods for identifying the relevant polynucleotides comprising biologically active g34665 regulatory fragments or variants of SEQ ID No 1 are further described herein. Thus, the present invention also relates to a purified or isolated nucleic acid comprising a polynucleotide which is selected from the group consisting of the 5' and 3' regulatory regions of g34665, or a sequence complementary thereto or a biologically active fragment or variant thereof.

g35017

In one aspect, the invention concerns g35017 genomic sequences consisting of, consisting essentially of, or comprising the sequence of nucleotide positions 94124 to 94964 of SEQ ID No 1, a sequence complementary thereto, as well as fragments and variants thereof. These polynucleotides may be purified, isolated, or recombinant.

The invention also encompasses a purified, isolated, or recombinant polynucleotide comprising a nucleotide sequence having at least 70, 75, 80, 85, 90, or 95% nucleotide identity with a nucleotide sequence of nucleotide positions 94124 to 94964 SEQ ID No 1 or a complementary sequence thereto or a fragment thereof. The nucleotide differences as regards to nucleotide positions 94124 to 94964 SEQ ID No 1 may be generally randomly distributed throughout the entire nucleic acid. Nevertheless, preferred nucleic acids are those wherein the nucleotide differences as regards to the nucleotide sequence of SEQ ID No 1 are predominantly located outside the coding sequences contained in the exons. These nucleic acids, as well as their fragments and variants, may be used as oligonucleotide primers or probes in order to detect the presence of a copy of the g35017 gene in a test sample, or alternatively in order to amplify a target nucleotide sequence within the g35017 sequences.

Another object of the invention consists of a purified, isolated, or recombinant nucleic acid that hybridizes with a g35017 nucleotide sequence of any of nucleotide positions 94124 to 94964 of SEQ ID No 1 or a complementary sequence thereto or a variant thereof, under the stringent hybridization conditions as defined above.

Particularly preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200 or 500 nucleotides of nucleotide position 94124 to 94964 of SEQ ID No 1 or the complements thereof. Particularly preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200 or 500 nucleotides of nucleotide position 94124 to 94964 of SEQ ID No 1 or the complements thereof, wherein said contiguous span comprises a g35017 related biallelic marker. Optionally, said biallelic marker is the biallelic marker designated A41 in Table 6b. It should be noted that nucleic acid fragments of any size and sequence may also be comprised by the polynucleotides described in this section.

While this section is entitled "Genomic Sequences of g35017," it should be noted that nucleic acid fragments of any size and sequence may also be comprised by the polynucleotides described in this section, flanking the genomic sequences of g35017 on either side or between two or more such genomic sequences.

A g35017 polynucleotide or gene may further contain regulatory sequences both in the non-coding 5'-flanking region and in the non-coding 3'-flanking region that border the region containing said genes or exons.

Polynucleotides derived from g35017 5' and 3' regulatory regions are useful in order to detect the presence of at least a copy of a nucleotide sequence comprising an g35017 nucleotide sequence of SEQ ID No. 1 or a fragment thereof in a test sample. Polynucleotides carrying the regulatory elements located at the 5' end and at the 3' end of the genes comprising the exons of the present invention may be advantageously used to control the transcriptional and translational activity of a heterologous polynucleotide of interest.

Methods for identifying the relevant polynucleotides comprising biologically active regulatory fragments or variants of a g35017 nucleic acid sequence of SEQ ID No 1 are further described herein. Thus, the present invention also relates to a purified or isolated nucleic acid comprising a polynucleotide which is selected from the group consisting of the 5' and 3' regulatory regions, or a sequence complementary thereto or a biologically active fragment or variant thereof. In one aspect, the 5' regulatory region may comprise a nucleotide sequence g35018

In one aspect, the invention concerns g35018 genomic sequences consisting of, consisting essentially of, or comprising the sequence of nucleotide positions 1108 to 65853 of SEQ ID No 1, a sequence complementary thereto, as well as fragments and variants thereof. These polynucleotides may be purified, isolated, or recombinant.

Particularly preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides, to the extent that said span is consistent with the nucleotide position range, of SEQ ID No 1, wherein said contiguous span comprises at least 1, 2, 3, 5, or 10 of the following nucleotide positions of SEQ ID No 1: 1108 to 65853, 1108 to 1289, 14877 to 14920, 18778 to 18862, 25593 to 25740, 29388 to 29502, 29967 to 30282, 64666 to 64812 and 65505 to 65853, or the complements thereof. Further preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides of nucleotide positions 1108 to 65853, 1108 to 1289, 14877 to 14920, 18778 to 18862, 25593 to 25740, 29388 to 29502, 29967 to 30282, 64666 to 64812 or 65505 to 65853 of SEQ ID No 1, or the complements thereof, wherein said contiguous span comprises a g35018 related biallelic marker. Optionally, said biallelic marker is selected from the group consisting of A1 to A39. It should be noted that nucleic acid fragments of any size and sequence may also be comprised by the polynucleotides described in this section.

The invention also encompasses a purified, isolated, or recombinant polynucleotide comprising a nucleotide sequence having at least 70, 75, 80, 85, 90, or 95% nucleotide identity with a nucleotide sequence of nucleotide positions 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854 of SEQ ID No 1 or a complementary sequence thereto or a fragment thereof. The nucleotide differences as regards to nucleotide positions 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854 of SEQ ID No 1 may be generally randomly distributed throughout the entire nucleic acid. Nevertheless, preferred nucleic acids are those wherein the nucleotide differences as regards to the nucleotide sequence of nucleotide positions 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854 of SEQ ID No 1 are predominantly located outside the coding sequences contained in the exons. These nucleic acids, as well as their fragments and variants, may be used as oligonucleotide primers or probes in order to detect the presence of a copy of the g35018 gene in a test sample, or alternatively in order to amplify a target nucleotide sequence within the g35018 sequences.

Another object of the invention consists of a purified, isolated, or recombinant nucleic acid that hybridizes with a g35018 nucleotide sequence of any of nucleotide positions 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854 SEQ ID No 1, or a complementary sequence thereto or a variant thereof, under the stringent hybridization conditions as defined above.

Yet further nucleic acids of the invention include isolated, purified, or recombinant polynucleotides comprising a contiguous span of at least 12, 15, 18, 20, 25, 30, 35, 40, 50, 60, 70, 80, 90, 100, 150, 200 or 500 nucleotides, to the extent that said span is consistent with the nucleotide position range, of SEQ ID No 1, wherein said contiguous span comprises at least 1, 2, 3, 5, or 10 of the following nucleotide positions of SEQ ID No 1: 1255 to 1289, 29967 to 30115, 30225 to 30282, or the complements thereof, as well as polynucleotides having at least 70, 75, 80, 85, 90, or 95% nucleotide identity with said span and polynucleotides capable of hybridizing with said span.

The g35018 genomic nucleic acid comprises at least 8 exons. The exon positions in SEQ ID No 1 are detailed below in Table 3.

TABLE 3

| | Position in SEQ ID No 1 | | | Position in SEQ ID No 1 | |
|---|---|---|---|---|---|
| Exon | Beginning | End | Intron | Beginning | End |
| A | 1108 | 1289 | A | 1290 | 14876 |
| B | 14877 | 14920 | B | 14921 | 18777 |
| Bbis | 18778 | 18862 | Bbis | 18863 | 25592 |
| C | 25593 | 25740 | C | 25741 | 29387 |
| D | 29388 | 29502 | D | 29503 | 29966 |
| E | 29967 | 30282 | E | 30283 | 64665 |
| F | 64666 | 64812 | F | 64813 | 65504 |
| G | 65505 | 65853 | | | |

Thus, the invention embodies purified, isolated, or recombinant polynucleotides comprising a nucleotide sequence selected from the group consisting of the 8 exons of the g35018 gene, or a sequence complementary thereto. The invention also deals with purified, isolated, or recombinant nucleic acids comprising a combination of at least two exons of the 35018 gene, wherein the polynucleotides are arranged within the nucleic acid, from the 5'-end to the 3'-end of said nucleic acid, in the same order as in SEQ ID No 1.

Intron 1 refers to the nucleotide sequence located between Exon 1 and Exon 2, and so on. The position of the introns is detailed in Table 3. Thus, the invention embodies purified, isolated, or recombinant polynucleotides comprising a nucleotide sequence selected from the group consisting of the 7 introns of the g35018 gene, or a sequence complementary thereto.

While this section is entitled "Genomic Sequences of g35018," it should be noted that nucleic acid fragments of any size and sequence may also be comprised by the polynucleotides described in this section, flanking the genomic sequences of g35018 on either side or between two or more such genomic sequences.

A g35018 polynucleotide or gene may further contain regulatory sequences both in the non-coding 5'-flanking region and in the non-coding 3'-flanking region that border the region containing said genes or exons.

Polynucleotides derived from 5' and 3' regulatory regions are useful in order to detect the presence of at least a copy of a nucleotide sequence comprising an g35018 nucleotide sequence of SEQ ID No. 1 or a fragment thereof in a test sample. Polynucleotides carrying the regulatory elements located at the 5' end and at the 3' end of the genes comprising the exons of the present invention may be advantageously used to control the transcriptional and translational activity of a heterologous polynucleotide of interest.

Methods for identifying the relevant polynucleotides comprising biologically active regulatory fragments or variants of SEQ ID No 1 are further described herein. Thus, the present invention also relates to a purified or isolated nucleic acid comprising a polynucleotide which is selected from the group consisting of the 5' and 3' regulatory regions, or a sequence complementary thereto or a biologically active fragment or variant thereof.

In one embodiment, a 5' regulatory region may comprise an isolated, purified, or recombinant polynucleotide comprising a contiguous span of at least 12, 15, 18, 20, 25, 30, 35, 40, 50, 60, 70, 80, 90, 100, 150, 200, 500, or 1000 nucleotides of nucleotide positions 31 to 1107 of SEQ ID No 1, or the complements thereof. In one embodiment, a 3' regulatory region may comprise an isolated, purified, or recombinant polynucleotide comprising a contiguous span of at least 12, 15, 18, 20, 25, 30, 35, 40, 50, 60, 70, 80, 90, 100, 150, 200, 500, or 1000 nucleotides of nucleotide positions 65854 to 67854 of SEQ ID No 1, or the complements thereof.

Genomic Sequences of sbg1 Polynucleotides

Particularly preferred nucleic acids of the invention include isolated, purified, or recombinant polynucleotides comprising, consisting essentially of, or consisting of a contiguous span of at least 12, 15, 18, 20, 25, 30, 35, 40, 50, 60, 70, 80, 90, 100, 150, 200, 500, or 1000 nucleotides of nucleotide positions 213818 to 243685 of SEQ ID No 1, or the complements thereof. Also encompassed are purified, isolated, or recombinant polynucleotide comprising a nucleotide sequence having at least 70, 75, 80, 85, 90, or 95% nucleotide identity with nucleotide positions 213818 to 243685 of SEQ ID No 1, or a complementary sequence thereto or a fragment thereof. Nucleic acids of the invention encompass an sbg1 nucleic acid from any source, including primate, non-human primate, mammalian and human sbg1 nucleic acids.

Further preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No 1 or the complements thereof, wherein said contiguous span comprises an sbg1 related biallelic marker. Optinally, said biallelic marker is selected from the group consisting of A85 to A219. Optionally, said biallelic marker is selected from the group consisting of A85 to A94, A96 to A106, A108 to A112, A114 to A177, A179 to A197 and A199 to A219.

It should be noted that nucleic acid fragments of any size and sequence may also be comprised by the polynucleotides described in this section.

The human sbg1 gene comprises exons selected from at least 22 different exons or exon forms, referred to herein as exons MS1, M1, M692, M862, MS2, M1069, M1090, M1117, N, N2, Nbis, O, O1, O2, Obis, P, X, Q1, Q, Qbis, Rbis and R. Of these, the following exon sets contain sequence overlap and do not occur together in an mRNA: exons M1, M692, M862, MS2, M1090 M1069 and M1117; exons MS1, M1, M692 and M862; exons N and N2; exons O1 and O2; exons Q and Qbis; exons R and R bis; and exons Q and Q1.

The nucleotide positions of sbg1 exons in SEQ ID No. 1 are detailed below in Table 4. The exon structure of the sbg1 gene is further shown in FIG. 1.

TABLE 4

| Exon | Position in SEQ ID No 1 | |
|---|---|---|
| | Beginning | End |
| R | 215819 | 215941 |
| Rbis | 215819 | 215975 |
| Qbis | 216661 | 216952 |
| Q | 216661 | 217061 |
| Q1 | 217027 | 217061 |
| X | 229647 | 229742 |
| P | 230408 | 230721 |
| Obis | 231272 | 231412 |
| O2 | 231787 | 231880 |
| O1 | 231870 | 231879 |
| O | 234174 | 234321 |
| Nbis | 237406 | 237428 |
| N2 | 239719 | 239807 |
| N | 239719 | 239853 |
| M117 | 240528 | 240569 |
| M1090 | 240528 | 240596 |
| M1069 | 240528 | 240617 |
| MS2 | 240528 | 240644 |
| M862 | 240528 | 240824 |
| M692 | 240528 | 240994 |
| M1 | 240528 | 241685 |
| MS1 | 240800 | 240993 |

Thus, the invention embodies purified, isolated, or recombinant polynucleotides comprising a nucleotide sequence selected from the group consisting of the exons of the sbg1 gene, or a sequence complementary thereto. Preferred are purified, isolated, or recombinant polynucleotides comprising at least one exon having the nucleotide position ranges listed in Table 4 selected from the group consisting of the exons MS1, M1, M692, M862, MS2, M1069, M1090, M1117, N, N2, Nbis, O, O1, O2, Obis, P, X, Q1, Q, Qbis, R and Rbis of the sbg1 gene, or a complementary sequence thereto or a fragment or a variant thereof. Also encompassed by the invention are purified, isolated, or recombinant nucleic acids comprising a combination of at least two exons of the sbg1 gene selected from the group consisting of exons MS1, M1, M692, M862, MS2, M1069, M1090, M1117, N, N2, Nbis, O, O1, O2, Obis, P, X, Q1, Q, Qbis, R and Rbis, wherein the polynucleotides are arranged within the nucleic acid in the same relative order as in SEQ ID No. 1.

Particularly preferred nucleic acids of the invention include isolated, purified, or recombinant polynucleotides comprising a contiguous span of at least 12, 15, 18, 20, 25, 30, 35, 40, 45, 50, 55, 60, 65, 70, 75, 80, 90, 100 or 200 nucleotides of SEQ ID No 1, wherein said contiguous span comprises at least 1, 2, 3, 5, or 10 of the following nucleotide positions of SEQ ID No 1: 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685, or the complements thereof.

Another object of the invention consists of a purified, isolated, or recombinant nucleic acid that hybridizes with an sbg1 nucleotide sequence of nucleotide positions 213818 to 243685, 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 or 241686 to 243685 of SEQ ID No 1, or a complementary sequence thereto or a variant thereof, under the stringent hybridization conditions as defined above.

The present invention further embodies purified, isolated, or recombinant polynucleotides comprising a nucleotide sequence selected from the group consisting of the introns of the sgb1 gene, or a sequence complementary thereto.

In other embodiments, the present invention encompasses the sgb1 gene as well as sgb1 genomic sequences consisting of, consisting essentially of, or comprising the sequence of nucleotide positions 215819 to 241685 of SEQ ID No 1, a sequence complementary thereto, as well as fragments and variants thereof.

The invention also encompasses a purified, isolated, or recombinant polynucleotide comprising a nucleotide sequence of sbg1 having at least 70, 75, 80, 85, 90, or 95% nucleotide identity with a sequence selected from the group consisting of nucleotide positions 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685 of SEQ ID No. 1 or a complementary sequence thereto or a fragment thereof. The nucleotide differences as regards the nucleotide positions 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685 of SEQ ID No. 1 may generally be distributed throughout the nucleic acid.

These nucleic acids, as well as their fragments and variants, may be used as oligonucleotide primers or probes in order to detect the presence of a copy of a gene comprising an sbg1 nucleic acid sequence in a test sample, or alternatively in order to amplify a target nucleotide sequence within an sbg1 nucleic acid sequence or adjoining region.

Additional preferred nucleic acids of the invention include isolated, purified, or recombinant sbg1 polynucleotides comprising a contiguous span of at least 12, 15, 18, 20, 25, 30, 35, 40, 45, 50, 55, 60, 65, 70, 75, 80, 90, 100 or 200 nucleotides of nucleotide positions 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993, 215819 to 241685 and 241686 to 243685 of SEQ ID No 1, or the complements thereof, wherein said contiguous span comprises at least one biallelic marker. Optionally, said contiguous span comprises an sbg1-related biallelic marker. It should be noted that nucleic acid fragments of any size and sequence may also be comprised by the polynucleotides described in this section. Either the original or the alternative allele may be present at said biallelic marker.

Yet further nucleic acids of the invention include isolated, purified, or recombinant polynucleotides comprising a contiguous span of at least 12, 15, 18, 20, 25, 30, 35, 40, 50, 60, 70, 80, 90, 100, 150, 200 or 500 nucleotides, to the extent that said span is consistent with the nucleotide position range, of SEQ ID No 1, wherein said contiguous span comprises at least 1, 2, 3, 5, or 10 of the following nucleotide positions of SEQ ID No 1: 215820 to 215941, 216661 to 217009, 230409 to 290721, 231272 to 231411, 234202 to 234321, 240528 to 240567, 240528 to 240827 and 240528 to 240996, or the complements thereof, as well as polynucleotides having at least 70, 75, 80, 85, 90, or 95% nucleotide identity with said span, and polynucleotides capable of hybridizing with said span.

The present invention also comprises a purified or isolated nucleic acid encoding an sbg1 protein having the amino acid sequence of any one of SEQ ID Nos 27 to 35 or a peptide fragment or variant thereof.

While this section is entitled "Genomic Sequences of sbg1," it should be noted that nucleic acid fragments of any size and sequence may also be comprised by the polynucleotides described in this section, flanking the genomic sequences sbg1 on either side or between two or more such genomic sequences.

Sbg1 cDNA Sequences

The expression of the sbg1 gene has been shown to lead to the production of several mRNA species. Several cDNA sequences corresponding to these mRNA are set forth in SEQ ID Nos 2 to 26.

The invention encompasses a purified, isolated, or recombinant nucleic acid comprising a nucleotide sequence selected from the group consisting of SEQ ID Nos 2 to 26, complementary sequences thereto, splice variants thereof, as well as allelic variants, and fragments thereof. Moreover, preferred polynucleotides of the invention include purified, isolated, or recombinant Sbg1 cDNAs consisting of, consisting essentially of, or comprising a nucleotide sequence selected from the group consisting of SEQ ID Nos 2 to 26. Particularly preferred nucleic acids of the invention include isolated, purified, or recombinant polynucleotides comprising a contiguous span of at least 8, 12, 15, 18, 20, 25, 30, 35, 40, 50, 60, 70, 75, 80, 100, 200 or 500 nucleotides, to the extent that the length of said contiguous span is consistent with the length of the SEQ ID, of a nucleotide sequence selected from the group consisting of SEQ ID Nos 2 to 26, or the complements thereof.

It should be noted that nucleic acid fragments of any size and sequence may also be comprised by the polynucleotides described in this section.

The invention also pertains to a purified or isolated nucleic acid comprising a polynucleotide having at least 70, 80, 85, 90 or 95% nucleotide identity with a polynucleotide selected from the group consisting of SEQ ID Nos 2 to 26, advantageously 99% nucleotide identity, preferably 99.5% nucleotide identity and most preferably 99.8% nucleotide identity with a polynucleotide selected from the group consisting of SEQ ID Nos 2 to 26, or a sequence complementary thereto or a biologically active fragment thereof.

Another object of the invention relates to purified, isolated or recombinant nucleic acids comprising a polynucleotide that hybridizes, under the stringent hybridization conditions defined herein, with a polynucleotide selected from the group consisting of SEQ ID Nos 2 to 26, or a sequence complementary thereto or a variant thereof or a biologically active fragment thereof.

The sbg1 cDNA forms of SEQ ID Nos 2 to 26 are further described in Table 5a below. Shown on the Table 5a are the positions of the 5' UTR, the open reading frame (ORF), the 3' UTR and the polyA signal on the respective SEQ ID No. Also shown are the sbg1 exons comprising the cDNA form of a particular SEQ ID No.

TABLE 5a

| SEQ ID No | cDNA | Pos range of 5UTR | | Pos range of ORF | | Pos range of 3UTR | | Pos range of polyA signal | |
|---|---|---|---|---|---|---|---|---|---|
| 2 | M862NOQbisR | 1 | 253 | 254 | 304 | 305 | 995 | 971 | 976 |
| 3 | M862NOObisP | 1 | 253 | 254 | 304 | 305 | 1035 | 1020 | 1025 |
| 4 | M1 | 1 | 187 | 188 | 520 | 521 | 1158 | — | — |
| 5 | M862NOP | 1 | 253 | 254 | 304 | 305 | 894 | 879 | 884 |
| 6 | M1090NOXQbisR | 1 | 25 | 26 | 76 | 77 | 863 | 839 | 844 |
| 7 | M1117N2OO1P | — | — | 2 | 310 | 311 | 603 | 588 | 593 |
| 8 | M1117N2OP | — | — | 2 | 358 | 359 | 593 | 578 | 583 |
| 9 | M1117NOO1P | — | — | 2 | 49 | 50 | 649 | 634 | 639 |
| 10 | M1117NOO2P | — | — | 2 | 49 | 50 | 733 | 718 | 723 |
| 11 | MS1MS2NOQbisR | 1 | 267 | 268 | 318 | 319 | 1009 | 985 | 990 |
| 12 | M1069NOQR | 1 | 46 | 47 | 97 | 98 | 897 | 873 | 878 |
| 13 | M1069N2OQ1QbisR | 1 | 46 | 47 | 343 | 344 | 777 | 753 | 758 |
| 14 | M1069NOQ1QbisR | 1 | 46 | 47 | 97 | 98 | 823 | 799 | 804 |
| 15 | M1069N2OO2QbisR | 1 | 46 | 47 | 427 | 428 | 836 | 812 | 817 |
| 16 | M1069NOO2QbisR | 1 | 46 | 47 | 97 | 98 | 882 | 858 | 863 |
| 17 | M1069N2NbisOO2XQbisR | 1 | 46 | 47 | 235 | 236 | 955 | 931 | 936 |
| 18 | M1069N2OQR | 1 | 46 | 47 | 343 | 344 | 851 | 827 | 832 |
| 19 | M1069N2OQbisR | 1 | 46 | 47 | 508 | 509 | 742 | 718 | 723 |
| 20 | M1069NNbisOQR | 1 | 46 | 47 | 97 | 98 | 920 | 896 | 901 |
| 21 | M1069NNbisOQbisR | 1 | 46 | 47 | 97 | 98 | 811 | 787 | 792 |
| 22 | M1069NOO2XQbisR | 1 | 46 | 47 | 97 | 98 | 978 | 954 | 959 |
| 23 | M1069NOXQR | 1 | 46 | 47 | 97 | 98 | 993 | 969 | 974 |
| 24 | M1069NOQbisRbis | 1 | 46 | 47 | 97 | 98 | 822 | — | — |
| 25 | M1069N2OQbisRbis | 1 | 46 | 47 | 508 | 509 | 776 | — | — |
| 26 | M1069N2OXQR | 1 | 46 | 47 | 367 | 368 | 947 | 923 | 928 |

Primers used to isolate the particular sbg1 cDNAs listed above from RNA from various tissues are provided below in Table 5b. Primers designed to hybridize to nucleic acid sequences of exons MS1, M862, M1090, M1117 and MS2, and exons P and R resulted in the cloning of multiple cDNA forms for several sets of primers. The primers used are listed in SEQ ID Nos 44 to 53.

mRNA forms of sbg1 were found to differ among tissues; Table 5c lists cDNA forms cloned from various tissues and the relative percentages and numbers of clones found per tissue for each listed sbg1 mRNA form.

The present inventors have also identified further variations in cDNA sequence as obtained from various tissues and compared with the consensus sbg1 genomic nucleotide sequence. The tissues from which cDNA was cloned were obtained from pooled individuals numbering from 11 to 60. Table 5d below describes the identities of variants, the nucleotide position of the variation in nucleotide sequence of SEQ ID No 2, and the number of samples having the specified sequence for each respective nucleotide position on the sbg1 cDNA sequence of SEQ ID No. 2. Also indicated in Table 5d are amino acid changes in the corresponding sbg1 polypeptide sequence (described herein), if any, resulting from the nucleotide sequence variations in the cDNA of SEQ ID No 2.

These variants may represent rare polymorphisms or may be the result of tissue-specific RNA editing. Alternatively, some variations may be the result of the presence in the human genome of one or more sbg1-related genes or a small family of sbg1-related genes with strict tissue specificity of expression and small variation in gene structure. The latter hypothesis was tested by applicants for the case where the exon-intron structure of these genes are identical, demonstrating that variations in at least exons M and N are not the result of the presence of related genes.

The present invention thus further encompasses variant sbg1 polynucleotides having at least one nucleotide substitution as described in Table 5d below. The nucleotide and amino acid variations as shown in Table 5d are shown in terms of the nucleotide sequence of SEQ ID No. 2, and specify variations as found in exons M862, N, O, Qbis and R. The invention encompasses purified, isolated, or recombinant polynucleotides and polypeptides encoded thereby, wherein the polynucleotides comprise a contiguous span of at least 8, 12, 15, 18, 20, 25, 30, 35, 40, 45, 50, 60, 70, 80, 100, 150, or 200 nucleotides of SEQ ID No 2 or the complement thereof, and wherein said contiguous span further comprises a nucleotide sequence variation according to Table 5d.

The present invention comprises a purified or isolated sbg1 cDNA encoding an sbg1 protein or a peptide fragment or variant thereof. In one embodiment, a purified or isolated nucleic acid encoding an sbg1 protein may have the amino acid sequence of any of SEQ ID Nos 27 to 35 or a peptide fragment or variant thereof.

Preferred nucleic acids of the invention also include isolated, purified, or recombinant polynucleotides comprising a contiguous span of at least 8, 12, 15, 18, 20, 25, 30, 35, 40, 50, 60, 70, 75, 80, 100, 200 or 500 nucleotides of a nucleotide sequence selected from the group consisting of SEQ ID Nos 2 to 26, or the complements thereof, wherein said span comprises a sbg1-related biallelic marker of the invention. The positions of selected biallelic markers of the invention in sbg1 cDNA sequences and polypeptide sequences are listed below in Table 5e. Said contiguous span may comprise a biallelic marker selected from the group of biallelic markers listed in Table 5e; optionally, said biallelic marker is selected from the group consisting of the biallelic markers located in an sbg1 cDNA form, as listed in Table 5e; optionally, said biallelic marker is selected from the group consisting of the biallelic markers located in an sbg1 coding sequence, as listed in Table 5e.

Expression of sbg1 mRNA was further confirmed by Northern blotting. Using a probe corresponding to exon O of the sbg1 gene, a band corresponding to an sbg1 mRNA was detected.

While this section is entitled "sbg1 cDNA Sequences," it should be noted that nucleic acid fragments of any size and sequence may also be comprised by the polynucleotides described in this section, flanking the genomic sequences of sbg1 on either side or between two or more such genomic sequences.

TABLE 5b

| PRIMERS | cDNA Form Observed | Tissue |
|---|---|---|
| g34872MbisEco CCCGAATTCCCAAACTTCTTTCATTTAAAGAACCA (SEQ ID No 26) g34872LR1309nBAmH1 ATGCGGGATCCAGAGATTCTCCCAGTCACACAGGCC (SEQ ID No 27) | MS1MS2NOQbisR | testis |
| g34872genoLF22nEcoRI TACTGGAATTCCAGGTAGAGTGAAGCAAGTAATGTGTGTGTGAG (SEQ ID No 28) g34872LR1309nBAmH1 ATGCGGGATCCAGAGATTCTCCCAGTCACACAGGC (SEQ ID No 27) | M862NOQbisR | testis amygdala caudate nucleus cerebellum hippocampus substantia nigra thalamus |
| g34872MterEco CGAGAATTCGATGATTTAGCTGGGAGGACCCAA (SEQ ID No 30) g34872LR1305nBam TCGGGATCCAGTCACACAGGCCAGGT (SEQ ID No 31) | M1090NOQBISR M1090NOXQBISR M1090N2OQBISR | testis |
| g34872LF1140ECOR1 GCTGGGAATTCGCTGGAAAAGCTGATGGGTGCTGATTCTC (SEQ ID No 32) g34872LR1309nBAmH1 ATGCGGGATCCAGAGATTCTCCCAGTCACACAGGC (SEQ ID No 27) | M1117NOQBISR M1117N2OQBISR M1117N2OQ2QbisR M1117NOO2QbisR M1117N2OQR | testis amygdala caudate nucleus cerebellum corpus callosum cortex hippocampus substantia nigra |
| g34872LF1064Eco TCAGAATTCTCATCTCTGCTTCACAATGCCG (SEQ ID No 34) g34872LR1309nBAmH1 ATGCGGGATCCAGAGATTCTCCCAGTCACACACCC (SEQ ID No 27) | MS2NOQ1QbisR MS2NOO2QbisR MS2N2OQ1QbisR MS2NOQR MS2NOQbisR | testis |
| g34872genoLF22nEcoRI TACTGGAATTCCAGGTAGAGTGAAGCAAGTAATGTGTGTGTGAG (SEQ ID No 28) g34872exRBAM139 ACGGGATCCTTTCAGTACTGAAGTTGAGAGGGAGA (SEQ ID No 35) g34872LF1140ECOR1 GCTGGGAATTCGCTGGAAAAGCTGATGGGTGCTGATTCTC (SEQ ID No 32) | M862NOObisP M862NOP | testis |
| g34872exRBAM139 ACGGGATCCTTTCAGTACTGAAGTTGAGAGGGAGA (SEQ ID No 33) | M1117NOP M1117N2OP M1117N2OO1P M1117NOO2P | testis |

TABLE 5c

| Primers for Cloning (exons) | Tissue | Percentage cDNA Form cloned |
|---|---|---|
| M688 and R | testicle | 100% MS1MS2NOQbisR (95 clones) |
| M862 and R | testicle | 100% M862NOQbisR (188 clones) |
| | amygdala | 100% M862NOQbisR (42 clones) |
| | caudate nucleus | 100% M862NOQbisR (39 clones) |
| | cerebellum | 100% M862NOQbisR (87 clones) |
| | hippocampus | 100% M862NOQbisR (36 clones) |
| | substantia nigra | 100% M862NOQbisR (96 clones) |
| | thalamus | 100% M862NOQbisR (30 clones) |
| M1090 and R | testicle | 45% M1090NOQBISR (5 clones) |
| | | 45% M1090NOQBISR (5 clones) |
| | | 10% M1090N2OQBISR (1 clone) |
| M1117 and R | testicle | 26% M1117NOQBISR (23 clones) |
| | | 70% M1117N2OQBISR (62 clones) |
| | | 2% M1117N2OO2QbisR (2 clones) |
| | | 1% M1117NOO2QbisR (1 clone) |
| | amygdala | 100% M1117NOQBISR (90 clones) |
| | caudate nucleus | 100% M1117NOQBISR (94 clones) |
| | cerebellum | 100% M1117NOQBISR (88 clones) |
| | corpus callosum | 100% M1117NOQBISR (94 clones) |
| | cortex | 100% M1117NOQBISR (95 clones) |
| | hippocampus | 100% M1117N2OQR (66 clones) |
| | substantia nigra | 100% M1117N2OQR (90 clones) |
| MS2 and R | testicle | 1% MS2N2OO2QbisR (1 clones) |
| | | 2% MS2N2OQ1QbisR (2 clones) |
| | | 19% MS2NOO2QbisR (18 clones) |
| | | 2% MS2NOQ1QbisR (2 clones) |
| | | 8% MS2NOQR (8 clones) |
| | | 67% MS2NOQbisR (63 clones) |
| M1069 and R | Testicle | 67% MNOQbisR |
| | | 16% MNOQR |
| | | 3% MN2OqbisR |
| | | 6% MNOXQR |
| | | 2% MN2OQR |
| | | 1% MNOO2XqbisR |
| | | 2% MNNbisOQbisR |
| | | 1% MNNbisOQR |
| | | 1% MN2NbisOO2XqbisR |
| | | 1% MN2OXQR |
| | Brain | 100% MNOQbisR |
| | Hypothalamus cDNA | 100% MN2OQbisR |
| | Cerebellum | 100% MNOQbisR |
| | Amygdala Cdna | 100% MN2OQbisR |
| | MOLT4 cells | 100% MN2OQR |

TABLE 5c-continued

| Primers for Cloning (exons) | Tissue | Percentage cDNA Form cloned |
|---|---|---|
| | Spinal cord | 57% MNOQbisR |
| | | 21% MN2OqbisR |
| | | 18% MNOQR |
| | | 3% MNOQbisRbis |
| | | 1% MN2OQbisRbis |
| M862 and P | testicle | 97% M862NOObisP (88 clones) |
| | | 3% M862NOP (3 clones) |
| M1117 and P | hippocampus | 100% M1117NOP (80 clones) |
| | testicle | 58% M1117NOP (54 clones) |
| | | 37% M1117N2OP (35 clones) |
| | | 1% M1117N2OO1P (1 clone) |
| | | 1% M1117NOO1P (1 clone) |
| | | 2% M1117NOO2P (2 clones) |
| M1117 and O | Testicle | MNO |
| | Cerebellum | MNO |
| | Hippocampus | MNO |
| | Caudate nucleus | MNO |
| | Corpus callosum | MNO |
| | Amygdala | MNO |
| | Lung | MNO |
| | Fetal liver | MNO |
| | Pancreas | MNO |
| | Stomach | MNO |
| | HL60 cell line | MNO |
| | Spinal cord | MN2O |
| | trachea | MN2O |

TABLE 5d sbg1 (exons M862NOQbisR)

| Pos (1 to 998) | genomic | testicle | cerebellum | Subs nigra | amygdala | caudate nucleus |
|---|---|---|---|---|---|---|
| 55 | A | 47A/1G | 25A | 43A/1G | 40A/2G | 17A/11G |
| 122 | A | 48A | 25A | 20G/24A | 40A/2G | 28A |
| 170 | T | 48T | 25T | 44T | 35T/7C | 19T/9C |
| 178 | G | 48G | 25G | 24G/20A | 42G | 28G |
| 209 | T | 47T/1C | 25T | 19T/25C | 41T/1A | 28T |
| 226 | A | 48A | 25A | 44A | 41A/1G | 28A |
| 248 | G | 48G | 25G | 44G | 38G/4A | 28G |
| 258 | T | 48T | 25C | 44T | 41T/1C | 28T |
| 286 | T | 48T | 25T | 44T | 42T | 24T/4C |
| 301 beginning of exon N | | | | | | |
| 325 | T/A:L->Q | 46T/2A | 25T | 44T | 36T/6A | 21T/7A |
| 351 | A/G:R->G | 48A | 25A | 43A/1G | 35A/7G | 28A |
| 391 | A/G:K->R | 48G | 25G | 44G | 42G | 28G |
| 393 | A/T:S->C | 48A | 25A | 44A | 29A/13T | 28A |
| 429 | T/C:S->P | 48T | 21T/4C | 44T | 42T | 28T |
| 436 beginning of exon O | | | | | | |
| 468 | A/G:T->A | 47A/1G | 25A | 1A | 15G/2A | 2G |
| 497 | T/C:H->H | 47T/1C | 25T | 1T/1C | 23T/2C | 12T |
| 511 | T/C:L->S | 48T | 25T | 28T | 31C/9T | 16C/11T/1N |
| 529 pr | A/G:H->R | 48A | 25A | 39A | 41A/1G | 18A/10G |
| 538 | G/A:R->K | 48G | 25G | 23G/17A | 42G | 28G |
| 540 | T/C:S->P | 48T | 25C | 40T | 42T | 28T |
| 571 | A/G:Q->R | 48A | 25A | 43A | 37A/5G | 24A/4G |
| 584 beginning of exon Qbis | | | | | | |
| 608 | T/C:V->V | 48T | 19T/6C | 44T | 42T | 28T |
| 616 | T/C:V->A | 48T | 25T | 44T | 41T/1C | 21T/7C |
| 702 | T/C:Y->H | 48T | 25T | 44T | 42T | 17T/11C |
| 706 | A/G:N->S | 48A | 24G/1A | 44A | 42A | 28A |
| 718 | A/G:D->G | 48A | 25A | 44A | 42A | 18A/10G |
| 803 | A | 48A | 25A | 44A | 38A/4G | 28A |
| 829 | C | 48C | 25C | 25C/19T | 41C/1N | 27C/1N |
| 856 | G | 42G/6A | 25G | 25G/19A | 32G/10A | 24G/4A |
| 876 beginning of exon R | | | | | | |
| 901 | C | 48C | 25C | 25C/19T | 40C/2N | 27C/1N |
| 915 | A | 46A/1G | 25A | 43A/1G | 29G/13A | 23G/5A |
| 934 | C | 46C | 25C | 43C/1T | 38C/4T | 28C |
| 938 | C | 46C | 25C | 44C | 31C/11T | 23C/5T |

TABLE 5e

| Amplicon | Biallelic Marker Name | Allele 1 | Allele 2 | Genomic position on SEQ ID No 1 | cDNA form: position of marker on cDNA (position in polypeptide) |
|---|---|---|---|---|---|
| 8-132 | 8-132-179 | A | T | 215838 | M862NOQbisR: 976<br>M1090NOXQbisR: 844<br>MS1<br>MS2NOQbisR: 990<br>M1069NOQR: 878<br>M1069N2OQ1QbisR: 758<br>M1069NOQ1QbisR: 804<br>M1069N2OO2QbisR: 817<br>M1069NOO2QbisR: 863<br>M1069N2NbisOO2XQbisR: 936<br>M1069N2OQR: 832<br>M1069N2OQbisR: 723<br>M1069NNbisOQR: 901<br>M1069NNbisOQbisR: 792<br>M1069NOO2XQbisR: 959<br>M1069NOXQR: 974<br>M1069NOQbisRbis: 803<br>M1069N2OQbisRbis: 757<br>M1069N2OXQR: 928 |
| 8-132 | 8-132-164 | A | G | 215853 | M862NOQbisR: 961<br>M1090NOXQbisR: 829<br>MS1<br>MS2NOQbisR: 975<br>M1069NOQR: 863<br>M1069N2OQ1QbisR: 743<br>M1069NOQ1QbisR: 789<br>M1069N2OO2QbisR: 802<br>M1069NOO2QbisR: 848<br>M1069N2NbisOO2XQbisR: 921<br>M1069N2OQR: 817<br>M1069N2OQbisR: 708<br>M1069NNbisOQR: 886<br>M1069NNbisOQbisR: 777<br>M1069NOO2XQbisR: 944<br>M1069NOXQR: 959<br>M1069NOQbisRbis: 788<br>M1069N2OQbisRbis: 742<br>M1069N2OXQR: 913 |
| 8-132 | 8-132-97 | A | G | 215920 | M862NOQbisR: 894<br>M1090NOXQbisR: 762<br>MS1<br>MS2NOQbisR: 908<br>M1069NOQR: 796<br>M1069N2OQ1QbisR: 676<br>M1069NOQ1QbisR: 722<br>M1069N2OO2QbisR: 735<br>M1069NOO2QbisR: 781<br>M1069N2NbisOO2XQbisR: 854<br>M1069N2OQR: 750<br>M1069N2OQbisR: 641<br>M1069NNbisOQR: 819<br>M1069NNbisOQbisR: 710<br>M1069NOO2XQbisR: 877<br>M1069NOXQR: 892<br>M1069NOQbisRbis: 721<br>M1069N2OQbisRbis: 675<br>M1069N2OXQR: 846 |
| 99-13929 | 99-13929-201 | G | T | 216028 | |
| 8-131 | 8-131-363 | G | T | 216538 | |
| 8-131 | 8-131-199 | G | T | 216702 | M862NOQbisR: 831<br>M1090NOXQbisR: 699<br>MS1<br>MS2NOQbisR: 845<br>M1069NOQR: 733<br>M1069N2OQ1QbisR: 613<br>M1069NOQ1QbisR: 659<br>M1069N2OO2QbisR: 672<br>M1069NOO2QbisR: 718<br>M1069N2NbisOO2XQbisR: 791<br>M1069N2OQR: 687<br>M1069N2OQbisR: 578<br>M1069NNbisOQR: 756<br>M1069NNbisOQbisR: 647<br>M1069NOO2XQbisR: 814 |

TABLE 5e-continued

| Amplicon | Biallelic Marker Name | Allele 1 | Allele 2 | Genomic position on SEQ ID No 1 | cDNA form: position of marker on cDNA (position in polypeptide) |
|---|---|---|---|---|---|
| 8-130 | 8-130-236 | C | T | 216874 | M1069NOXQR: 829<br>M1069NOQbisRbis: 624<br>M1069N2OQbisRbis: 578<br>M1069N2OXQR: 783<br>M862NOQbisR: 659<br>M1090NOXQbisR: 527<br>MS1<br>MS2NOQbisR: 673<br>M1069NOQR: 561<br>M1069N2OQ1QbisR: 441<br>M1069NOQ1QbisR: 487<br>M1069N2OO2QbisR: 500<br>M1069NOO2QbisR: 546<br>M1069N2NbisOO2XQbisR: 619<br>M1069N2OQR: 515<br>M1069N2OQbisR: 406<br>M1069NNbisOQR: 584<br>M1069NNbisOQbisR: 475<br>M1069NOO2XQbisR: 642<br>M1069NOXQR: 657<br>M1069NOQbisRbis: 452<br>M1069N2OQbisRbis: 406 |
| 8-130 | 8-130-220 | G | T | 216890 | M1069N2OXQR: 611<br>M862NOQbisR: 643<br>M1090NOXQbisR: 511<br>MS1<br>MS2NOQbisR: 657<br>M1069NOQR: 545<br>M1069N2OQ1QbisR: 425<br>M1069NOQ1QbisR: 471<br>M1069N2OO2QbisR: 484<br>M1069NOO2QbisR: 530<br>M1069N2NbisOO2XQbisR: 603<br>M1069N2OQR: 499<br>M1069N2OQbisR: 390 (115)<br>M1069NNbisOQR: 568<br>M1069NNbisOQbisR: 459<br>M1069NOO2XQbisR: 626<br>M1069NOXQR: 641<br>M1069NOQbisRbis: 436<br>M1069N2OQbisRbis: 390 (115)<br>M1069N2OXQR: 595 |
| 8-130 | 8-130-144 | C | T | 216966 | M1069NOQR: 469<br>M1069N2OQR: 423<br>M1069NNbisOQR: 492<br>M1069NOXQR: 565<br>M1069N2OXQR: 519 |
| 8-130 | 8-130-143 | A | G | 216967 | M1069NOQR: 468<br>M1069N2OQR: 422<br>M1069NNbisOQR: 491<br>M1069NOXQR: 564<br>M1069N2OXQR: 518 |
| 8-130 | 8-130-102 | C | T | 217008 | M1069NOQR: 427<br>M1069N2OQR: 381<br>M1069NNbisOQR: 450<br>M1069NOXQR: 523<br>M1069N2OXQR: 477 |
| 8-130 | 8-130-101 | G | T | 217009 | M1069NOQR: 426<br>M1069N2OQR: 380<br>M1069NNbisOQR: 449<br>M1069NOXQR: 522<br>M1069N2OXQR: 476 |
| 8-130 | 8-130-83 | A | C | 217027 | M1069NOQR: 408<br>M1069N2OQ1QbisR: 362<br>M1069NOQ1QbisR: 408<br>M1069N2OQR: 362<br>M1069NNbisOQR: 431<br>M1069NOXQR: 504<br>M1069N2OXQR: 458 |
| 8-143 | 8-143-245 | G | T | 229669 | M1090NOXQbisR: 426<br>M1069N2NbisOO2XQbisR: 518<br>M1069NOO2XQbisR: 541<br>M1069NOXQR: 447<br>M1069N2OXQR: 401 |

TABLE 5e-continued

| Amplicon | Biallelic Marker Name | Allele 1 | Allele 2 | Genomic position on SEQ ID No 1 | cDNA form: position of marker on cDNA (position in polypeptide) |
|---|---|---|---|---|---|
| 8-143 | 8-143-242 | A | G | 229672 | M1090NOXQbisR: 423<br>M1069N2NbisOO2XQbisR: 515<br>M1069NOO2XQbisR: 538<br>M1069NOXQR: 444<br>M1069N2OXQR: 398 |
| 8-143 | 8-143-239 | C | T | 229675 | M1090NOXQbisR: 420<br>M1069N2NbisOO2XQbisR: 512<br>M1069NOO2XQbisR: 535<br>M1069NOXQR: 441<br>M1069N2OXQR: 395 |
| 8-143 | 8-143-232 | G | C | 229682 | M1090NOXQbisR: 413<br>M1069N2NbisOO2XQbisR: 505<br>M1069NOO2XQbisR: 528<br>M1069NOXQR: 434<br>M1069N2OXQR: 388 |
| 8-119 | 8-119-210 | A | C | 230432 | M862NOObisP: 1011<br>M862NOP: 870<br>M1117N2OO1P: 579<br>M1117N2OP: 569<br>M1117NOO1P: 625<br>M1117NOO2P: 709 |
| 8-119 | 8-119-204 | A | C | 230438 | M862NOObisP: 1005<br>M862NOP: 864<br>M1117N2OO1P: 573<br>M1117N2OP: 563<br>M1117NOO1P: 619<br>M1117NOO2P: 703 |
| 8-119 | 8-119-200 | A | G | 230442 | M862NOObisP: 1001<br>M862NOP: 860<br>M1117N2OO1P: 569<br>M1117N2OP: 559<br>M1117NOO1P: 615<br>M1117NOO2P: 699 |
| 8-119 | 8-119-195 | A | C | 230447 | M862NOObisP: 996<br>M862NOP: 855<br>M1117N2OO1P: 564<br>M1117N2OP: 554<br>M1117NOO1P: 610<br>M1117NOO2P: 694 |
| 8-119 | 8-119-125 | C | T | 230517 | M862NOObisP: 926<br>M862NOP: 785<br>M1117N2OO1P: 494<br>M1117N2OP: 484<br>M1117NOO1P: 540<br>M1117NOO2P: 624 |
| 8-119 | 8-119-120 | A | G | 230522 | M862NOObisP: 921<br>M862NOP: 780<br>M1117N2OO1P: 489<br>M1117N2OP: 479<br>M1117NOO1P: 535<br>M1117NOO2P: 619 |
| 8-119 | 8-119-97 | C | T | 230545 | M862NOObisP: 898<br>M862NOP: 757<br>M1117N2OO1P: 466<br>M1117N2OP: 456<br>M1117NOO1P: 512<br>M1117NOO2P: 596 |
| 8-119 | 8-119-93 | G | T | 230549 | M862NOObisP: 894<br>M862NOP: 753<br>M1117N2OO1P: 462<br>M1117N2OP: 452<br>M1117NOO1P: 508<br>M1117NOO2P: 592 |
| 8-119 | 8-119-38 | A | T | 230604 | M862NOObisP: 839<br>M862NOP: 698<br>M1117N2OO1P: 407<br>M1117N2OP: 397<br>M1117NOO1P: 453<br>M1117NOO2P: 537 |
| 8-138 | 8-138-234 | C | T | 230684 | M862NOObisP: 759<br>M862NOP: 618<br>M1117N2OO1P: 327<br>M1117N2OP: 317 10<br>M1117NOO1P: 373 |

TABLE 5e-continued

| Amplicon | Biallelic Marker Name | Allele 1 | Allele 2 | Genomic position on SEQ ID No 1 | cDNA form: position of marker on cDNA (position in polypeptide) |
|---|---|---|---|---|---|
| 8-138 | 8-138-218 | A | G | 230700 | M1117NOO2P: 457<br>M862NOObisP: 743<br>M862NOP: 602<br>M1117N2OO1P: 311<br>M1117N2OP: 301<br>M1117NOO1P: 357<br>M1117NOO2P: 441 |
| 8-142 | 8-142-211 | CAAA | — | 231293 | M862NOObisP: 700 |
| 8-142 | 8-142-132 | A | G | 231372 | M862NOObisP: 621 |
| 8-145 | 8-145-197 | C | T | 231811 | M1117NOO2P: 395<br>M1069N2OO2QbisR: 397<br>M1069NOO2QbisR: 443<br>M1069N2NbisOO2XQbisR: 420<br>M1069NOO2XQbisR: 443 |
| 8-145 | 8-145-154 | C | T | 231854 | 231854<br>M1117NOO2P: 352<br>M1069N2OO2QbisR: 354 |
| 8-145 | 8-145-138 | A | C | 231870 | M1117N2OO1P: 289 (96)<br>M1117NOO1P: 335<br>M1117NOO2P: 336<br>M1069N2OO2QbisR: 338 (98)<br>M1069NOO2QbisR: 384<br>M1069N2NbisOO2XQbisR: 361<br>M1069NOO2XQbisR: 384 |
| 8-137 | 8-137-182 | C | T | 234277 | M862NOQbisR: 477<br>M862NOObisP: 477<br>M862NOP: 477<br>M1090NOXQbisR: 249<br>M1117N2OO1P: 176 (59)<br>M1117N2OP: 176 (59)<br>M1117NOO1P: 222<br>M1117NOO2P: 222<br>MS1<br>MS2NOQbisR: 491<br>M1069NOQR: 270<br>M1069N2OQ1QbisR: 224 (60)<br>M1069NOQ1QbisR: 270<br>M1069N2OO2QbisR: 224 (60)<br>M1069NOO2QbisR: 270<br>M1069N2NbisOO2XQbisR: 247<br>M1069N2OQR: 224 (60)<br>M1069N2OQbisR: 224 (60) |
| 8-137 | 8-37-152 | A | C | 234307 | M862NOQbisR: 447<br>M862NOObisP: 447<br>M862NOP: 447<br>M1090NOXQbisR: 219<br>M1117N2OO1P: 146 (49)<br>M1117N2OP: 146 (49)<br>M1117NOO1P: 192<br>M1117NOO2P: 192<br>MS1<br>MS2NOQbisR: 461<br>M1069NOQR: 240<br>M1069N2OQ1QbisR: 194 (50)<br>M1069NOQ1QbisR: 240<br>M1069N2OO2QbisR: 194 (50)<br>M1069NOO2QbisR: 240<br>M1069N2NbisOO2XQbisR: 217 (57)<br>M1069N2OQR: 194 (50)<br>M1069N2OQbisR: 194 (50)<br>M1069NNbisOQR: 263<br>M1069NNbisOQbisR: 263<br>M1069NOO2XQbisR: 240<br>M1069NOXQR: 240<br>M1069NOQbisRbis: 240<br>M1069N2OQbisRbis: 194 (50)<br>M1069N2OXQR: 194 (50) |
| 99-16038 | 99-16038-118 | C | T | 239763 | M862NOQbisR: 388<br>M862NOObisP: 388<br>M862NOP: 388<br>M1090NOXQbisR: 160<br>M1117N2OO1P: 87 (29)<br>M1117N2OP: 87 (29)<br>M1117NOO1P: 133 |

TABLE 5e-continued

| Amplicon | Biallelic Marker Name | Allele 1 | Allele 2 | Genomic position on SEQ ID No 1 | cDNA form: position of marker on cDNA (position in polypeptide) |
|---|---|---|---|---|---|
| | | | | | M1117NOO2P: 133 |
| | | | | | MS1 |
| | | | | | MS2NOQbisR: 402 |
| | | | | | M1069NOQR: 181 |
| | | | | | M1069N2OQ1QbisR: 135 (30) |
| | | | | | M1069NOQ1QbisR: 181 |
| | | | | | M1069N2OO2QbisR: 135 (30) |
| | | | | | M1069NOO2QbisR: 181 |
| | | | | | M1069N2NbisOO2XQbisR: 135 (30) |
| | | | | | M1069N2OQR: 135 (30) |
| | | | | | M1069N2OQbisR: 135 (30) |
| | | | | | M1069NNbisOQR: 181 |
| | | | | | M1069NNbisOQbisR: 181 |
| | | | | | M1069NOO2XQbisR: 181 |
| | | | | | M1069NOXQR: 181 |
| | | | | | M1069NOQbisRbis: 181 |
| | | | | | M1069N2OQbisRbis: 135 (30) |
| | | | | | M1069N2OXQR: 135 (30) |
| 8-153 | 8-153-313 | C | T | 239763 | M862NOQbisR: 388 |
| | | | | | M862NOObisP: 388 |
| | | | | | M862NOP: 388 |
| | | | | | M1090NOXQbisR: 160 |
| | | | | | M1117N2OO1P: 87 (29) |
| | | | | | M1117N2OP: 87 (29) |
| | | | | | M1117NOO1P: 133 |
| | | | | | M1117NOO2P: 133 |
| | | | | | MS1 |
| | | | | | MS2NOQbisR: 402 |
| | | | | | M1069NOQR: 181 |
| | | | | | M1069N2OQ1QbisR: 135 (30) |
| | | | | | M1069NOQ1QbisR: 181 |
| | | | | | M1069N2OO2QbisR: 135 (30) |
| | | | | | M1069NOO2QbisR: 181 |
| | | | | | M1069N2NbisOO2XQbisR: 135 (30) |
| | | | | | M1069N2OQR: 135 (30) |
| | | | | | M1069N2OQbisR: 135 (30) |
| | | | | | M1069NNbisOQR: 181 |
| | | | | | M1069NNbisOQbisR: 181 |
| | | | | | M1069NOO2XQbisR: 181 |
| | | | | | M1069NOXQR: 181 |
| | | | | | M1069NOQbisRbis: 181 |
| | | | | | M1069N2OQbisRbis: 135 (30) |
| | | | | | M1069N2OXQR: 135 (30) |
| 8-135 | 8-135-166 | G | T | 240543 | M862NOQbisR: 282 (10) |
| | | | | | M862NOObisP: 282 (10) |
| | | | | | M1: 1143 |
| | | | | | M862NOP: 282 (10) |
| | | | | | M1090NOXQbisR: 54 (10) |
| | | | | | M1117N2OO1P: 27 (9) |
| | | | | | M1117N2OP: 27 (9) |
| | | | | | M1117NOO1P: 27 (9) |
| | | | | | M1117NOO2P: 27 (9) |
| | | | | | MS1 |
| | | | | | MS2NOQbisR: 296 (10) |
| | | | | | M1069NOQR: 75 (10) |
| | | | | | M1069N2OQ1QbisR: 75 (10) |
| | | | | | M1069NOQ1QbisR: 75 (10) |
| | | | | | M1069N2OO2QbisR: 75 (10) |
| | | | | | M1069NOO2QbisR: 75 (10) |
| | | | | | M1069N2NbisOO2XQbisR: 75 (10) |
| | | | | | M1069N2OQR: 75 (10) |
| | | | | | M1069N2OQbisR: 75 (10) |
| | | | | | M1069NNbisOQR: 75 (10) |
| | | | | | M1069NNbisOQbisR: 75 (10) |
| | | | | | M1069NOO2XQbisR: 75 (10) |
| | | | | | M1069NOXQR: 75 (10) |
| | | | | | M1069NOQbisRbis: 75 (10) |
| | | | | | M1069N2OQbisRbis: 75 (10) |
| | | | | | M1069N2OXQR: 75 (10) |
| 8-135 | 8-135-112 | A | G | 240597 | M862NOQbisR: 228 |
| | | | | | M862NOObisP: 228 |
| | | | | | M1: 1089 |
| | | | | | M862NOP: 228 |
| | | | | | MS1 |

TABLE 5e-continued

| Amplicon | Biallelic Marker Name | Allele 1 | Allele 2 | Genomic position on SEQ ID No 1 | cDNA form: position of marker on cDNA (position in polypeptide) |
|---|---|---|---|---|---|
| | | | | | MS2NOQbisR: 242 |
| | | | | | M1069NOQR: 21 |
| | | | | | M1069N2OQ1QbisR: 21 |
| | | | | | M1069NOQ1QbisR: 21 |
| | | | | | M1069N2OO2QbisR: 21 |
| | | | | | M1069NOO2QbisR: 21 |
| | | | | | M1069N2NbisOO2XQbisR: 21 |
| | | | | | M1069N2OQR: 21 |
| | | | | | M1069N2OQbisR: 21 |
| | | | | | M1069NNbisOQR: 21 |
| | | | | | M1069NNbisOQbisR: 21 |
| | | | | | M1069NOO2XQbisR: 21 |
| | | | | | M1069NOXQR: 21 |
| | | | | | M1069NOQbisRbis: 21 |
| | | | | | M1069N2OQbisRbis: 21 |
| | | | | | M1069N2OXQR: 21 |
| 99-16050 | 99-16050-235 | G | C | 240772 | M862NOQbisR: 53 |
| | | | | | M862NOObisP: 53 |
| | | | | | M1: 914 |
| | | | | | M862NOP: 53 |
| 8-144 | 8-144-378 | C | T | 240858 | M1: 828 |
| | | | | | MS1 |
| | | | | | MS2NOQbisR: 136 |
| 8-144 | 8-144-234 | C | T | 241002 | M1: 684 |
| 8-144 | 8-144-196 | A | T | 241040 | M1: 646 |
| 8-144 | 8-144-127 | TGGATAC | — | 241109 | M1: 577 |
| 8-141 | 8-141-304 | C | T | 241217 | M1: 469 |
| 8-141 | 8-141-260 | C | T | 241261 | M1: 425 (80) |
| 8-141 | 8-141-161 | G | T | 241360 | M1: 326 (47) |
| 8-140 | 8-140-286 | A | G | 241507 | M1: 179 |
| 8-140 | 8-140-173 | A | C | 241620 | M1: 66 |
| 8-140 | 8-140-108 | G | C | 241685 | M1: 1 |

Sbg1 Coding Regions

The sbg1 open reading frame is contained in the corresponding mRNA of a cDNA sequence selected from the group consisting of SEQ ID Nos 2 to 26. The effective sbg1 coding sequence (CDS) may include several forms as indicated above, in some embodiments encompassing isolated, purified, and recombinant polynucleotides which encode a polypeptide comprising a contiguous span of at least 4 amino acids, preferably 6, more preferably at least 8 or 10 amino acids, yet more preferably at least 12, 15, 20, 25, 30, 40, 50, or 100 amino acids of SEQ ID Nos 27 to 35. The effective sbg1 coding sequence (CDS) may comprise the region between the first nucleotide of the ATG codon and the end nucleotide of the stop codon of SEQ ID Nos 2 to 26 as indicated in Table 5a above.

The above disclosed polynucleotide that contains the coding sequence of the sbg1 gene may be expressed in a desired host cell or a desired host organism when this polynucleotide is placed under the control of suitable expression signals. The expression signals may be either the expression signals contained in the regulatory regions in the sbg1 gene of the invention or in contrast the signals may be exogenous regulatory nucleic sequences. Such a polynucleotide, when placed under the suitable expression signals, may also be inserted in a vector for its expression and/or amplification.

Regulatory Sequences of sbg1

As mentioned, the genomic sequence of the sbg1 gene contains regulatory sequences both in the non-coding 5'-flanking region and in the non-coding 3'-flanking region that border the sbg1 coding region containing the exons of the gene.

In one aspect, the 3'-regulatory sequence of the sbg1 gene may comprise the sequence localized between the nucleotide in position 213818 and the nucleotide in position 215818 of the nucleotide sequence of SEQ ID No 1. In one aspect, the 5'-regulatory sequence of the sbg1 gene may comprise the sequence localized between the 5' end of the particular form of exon M and nucleotide position 243685 of SEQ ID No 1.

Polynucleotides derived from the 5' and 3' regulatory regions are useful in order to detect the presence of at least a copy of an sbg1 nucleotide sequence of SEQ ID No 1 or a fragment thereof in a test sample.

The promoter activity of the 5' regulatory regions contained in sbg1 can be assessed as described below.

In order to identify the relevant biologically active polynucleotide fragments or variants of an sbg1 regulatory region, one of skill in the art will refer to Sambrook et al. (1989), incorporated herein by reference, which describes the use of a recombinant vector carrying a marker gene (i.e. beta galactosidase, chloramphenicol acetyl transferase, etc.) the expression of which will be detected when placed under the control of a biologically active polynucleotide fragment or variant of the sbg1 sequence of SEQ ID No 1. Genomic sequences located upstream of the first exon of the sbg1 gene are cloned into a suitable promoter reporter vector, such as the pSEAP-Basic, pSEAP-Enhancer, pβgal-Basic, pβgal-Enhancer, or pEGFP-1 Promoter Reporter vectors available from Clontech, or pGL2-basic or pGL3-basic promoterless luciferase reporter gene vector from Promega. Briefly, each of these promoter reporter vectors include multiple cloning sites positioned upstream of a reporter gene encoding a readily assayable protein such as secreted alkaline phosphatase, luciferase, β galactosidase, or green fluorescent protein. The sequences upstream of the sbg1 coding region are inserted into the cloning sites upstream of the reporter gene in both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for increasing transcription levels from weak promoter sequences. A significant level of expression above that observed with the vector lacking an insert indicates that a promoter sequence is present in the inserted upstream sequence.

Promoter sequence within the upstream genomic DNA may be further defined by constructing nested 5' and/or 3' deletions in the upstream DNA using conventional techniques such as Exonuclease III or appropriate restriction endonuclease digestion. The resulting deletion fragments can be inserted into the promoter reporter vector to determine whether the deletion has reduced or obliterated promoter activity, such as described, for example, by Coles et al. (1998), the disclosure of which is incorporated herein by reference in its entirety. In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into cloning sites in promoter reporter vectors. This type of assay is well-known to those skilled in the art and is described in WO 97/17359, U.S. Pat. No. 5,374,544; EP 582 796; U.S. Pat. No. 5,698,389; U.S. Pat. No. 5,643,746; U.S. Pat. No. 5,502,176; and U.S. Pat. No. 5,266,488; the disclosures of which are incorporated by reference herein in their entirety.

The strength and the specificity of the promoter of the sbg1 gene can be assessed through the expression levels of a detectable polynucleotide operably linked to the sbg1 promoter in different types of cells and tissues. The detectable polynucleotide may be either a polynucleotide that specifically hybridizes with a predefined oligonucleotide probe, or a polynucleotide encoding a detectable protein, including an sbg1 polypeptide or a fragment or a variant thereof. This type of assay is well-known to those skilled in the art and is described in U.S. Pat. No. 5,502,176; and U.S. Pat. No. 5,266,488; the disclosures of which are incorporated by reference herein in their entirety. Some of the methods are discussed in more detail below.

Polynucleotides carrying the regulatory elements located at the 5' end and at the 3' end of the sbg1 coding region may be advantageously used to control the transcriptional and translational activity of an heterologous polynucleotide of interest.

Thus, the present invention also concerns a purified or isolated nucleic acid comprising a polynucleotide which is selected from the group consisting of the 5' and 3' regulatory regions of sbg1, or a sequence complementary thereto or a biologically active fragment or variant thereof. In one aspect, "3' regulatory region" may comprise the nucleotide sequence located between positions 213818 and 215818 of SEQ ID No 1. In one aspect, "5' regulatory region" may comprise the nucleotide sequence located between the 5' end of a particular variant of exon M and nucleotide position 243685 of SEQ ID No 1. The 5' end of particular form of exon M may be selected from the group consisting of nucleotide postions 240569, 241596, 240617, 240644, 240824, 240994, 241685 and 240993 of SEQ ID No 1. In a preferred aspect, the 5' regulatory region comprises the nucleotides of nucleotide positions 241686 to 243685 of SEQ ID No 1.

The invention also pertains to a purified or isolated nucleic acid comprising a polynucleotide having at least 95% nucleotide identity with a polynucleotide selected from the group consisting of the 5' and 3' regulatory regions, advantageously 99% nucleotide identity, preferably 99.5% nucleotide identity and most preferably 99.8% nucleotide identity with a polynucleotide selected from the group consisting of the 5' and 3' regulatory regions, or a sequence complementary thereto or a variant thereof or a biologically active fragment thereof.

Another object of the invention consists of purified, isolated or recombinant nucleic acids comprising a polynucleotide that hybridizes, under the stringent hybridization conditions defined herein, with a polynucleotide selected from the group consisting of the nucleotide sequences of the 5'- and 3' regulatory regions of sbg1, or a sequence complementary thereto or a variant thereof or a biologically active fragment thereof.

Preferred fragments of the 5' regulatory region have a length of about 1500 or 1000 nucleotides, preferably of about 500 nucleotides, more preferably about 400 nucleotides, even more preferably 300 nucleotides and most preferably about 200 nucleotides.

Preferred fragments of the 3' regulatory region are at least 50, 100, 150, 200, 300 or 400 bases in length.

"Biologically active" sbg1 polynucleotide derivatives of SEQ ID No 1 are polynucleotides comprising or alternatively consisting in a fragment of said polynucleotide which is functional as a regulatory region for expressing a recombinant polypeptide or a recombinant polynucleotide in a recombinant cell host. It could act either as an enhancer or as a repressor.

For the purpose of the invention, a nucleic acid or polynucleotide is "functional" as a regulatory region for expressing a recombinant polypeptide or a recombinant polynucleotide if said regulatory polynucleotide contains nucleotide sequences which contain transcriptional and translational regulatory information, and such sequences are "operably linked" to nucleotide sequences which encode the desired polypeptide or the desired polynucleotide.

The regulatory polynucleotides of the invention may be prepared from the nucleotide sequence of SEQ ID No 1 by cleavage using suitable restriction enzymes, as described for example in Sambrook et al. (1989). The regulatory polynucleotides may also be prepared by digestion of SEQ ID No 1 by an exonuclease enzyme, such as Bal31 (Wabiko et al., 1986). These regulatory polynucleotides can also be prepared by nucleic acid chemical synthesis, as described elsewhere in the specification.

The sbg1 regulatory polynucleotides according to the invention may be part of a recombinant expression vector that may be used to express a coding sequence in a desired host cell or host organism. The recombinant expression vectors according to the invention are described elsewhere in the specification.

A preferred 5'-regulatory polynucleotide of the invention includes the 5'-untranslated region (5'-UTR) of the sbg1 cDNA, or a biologically active fragment or variant thereof.

A preferred 3'-regulatory polynucleotide of the invention includes the 3'-untranslated region (3'-UTR) of the sbg1 cDNA, or a biologically active fragment or variant thereof.

A further object of the invention consists of a purified or isolated nucleic acid comprising:

a) a nucleic acid comprising a regulatory nucleotide sequence selected from the group consisting of:
(i) a nucleotide sequence comprising a polynucleotide of the sbg1 5' regulatory region or a complementary sequence thereto;
(ii) a nucleotide sequence comprising a polynucleotide having at least 95% of nucleotide identity with the nucleotide sequence of the sbg1 5' regulatory region or a complementary sequence thereto;
(iii) a nucleotide sequence comprising a polynucleotide that hybridizes under stringent hybridization conditions with the nucleotide sequence of the sbg1 5' regulatory region or a complementary sequence thereto; and
(iv) a biologically active fragment or variant of the polynucleotides in (i), (ii) and (iii);
b) a polynucleotide encoding a desired polypeptide or a nucleic acid of interest, operably linked to the nucleic acid defined in (a) above; and
c) optionally, a nucleic acid comprising a 3'-regulatory polynucleotide, preferably a 3'-regulatory polynucleotide of the sbg1 gene.

In a specific embodiment of the nucleic acid defined above, said nucleic acid includes the 5'-untranslated region (5'-UTR) of the sbg1 cDNA, or a biologically active fragment or variant thereof.

In a second specific embodiment of the nucleic acid defined above, said nucleic acid includes the 3'-untranslated region (3'-UTR) of the sbg1 cDNA, or a biologically active fragment or variant thereof.

The regulatory polynucleotide of the 5' regulatory region, or its biologically active fragments or variants, is operably linked at the 5'-end of the polynucleotide encoding the desired polypeptide or polynucleotide.

The regulatory polynucleotide of the 3' regulatory region, or its biologically active fragments or variants, is advantageously operably linked at the 3'-end of the polynucleotide encoding the desired polypeptide or polynucleotide.

The desired polypeptide encoded by the above-described nucleic acid may be of various nature or origin, encompassing proteins of prokaryotic or eukaryotic origin. Among the polypeptides expressed under the control of an sbg1 regulatory region include bacterial, fungal or viral antigens. Also encompassed are eukaryotic proteins such as intracellular proteins, like "house keeping" proteins, membrane-bound proteins, like receptors, and secreted proteins like endogenous mediators such as cytokines. The desired polypeptide may be the sbg1 protein, especially the protein of the amino acid sequences of SEQ ID Nos 27 to 35, or a fragment or a variant thereof.

The desired nucleic acids encoded by the above-described polynucleotide, usually an RNA molecule, may be complementary to a desired coding polynucleotide, for example to the sbg1 coding sequence, and thus useful as an antisense polynucleotide.

Such a polynucleotide may be included in a recombinant expression vector in order to express the desired polypeptide or the desired nucleic acid in host cell or in a host organism. Suitable recombinant vectors that contain a polynucleotide such as described herein are disclosed elsewhere in the specification.

Genomic Sequences of sbg2 Polynucleotides

Particularly preferred sbg2 nucleic acids of the invention include isolated, purified, or recombinant polynucleotides comprising a contiguous span of at least 12, 15, 18, 20, 25, 30, 35, 40, 50, 60, 70, 80, 90, 100, 150, 200 nucleotides, to the extent that the length of said span is consistent with said nucleotide position range, of nucleotide positions 201188 to 216915, 201188 to 201234, 214676 to 214793, 215702 to 215746 and 216836 to 216915 of SEQ ID No 1, or the complements thereof.

It should be noted that nucleic acid fragments of any size and sequence may be comprised by the polynucleotides described in this section.

The human sbg2 gene comprises exons selected from at least 4 exons, referred to herein as exons S, T, U and V. The nucleotide positions of sbg2 exons in SEQ ID No. 1 are detailed below in Table 5f.

TABLE 5f

| | Position in SEQ ID No 1 | | | Position in SEQ ID No 1 | |
| --- | --- | --- | --- | --- | --- |
| Exon | Beginning | End | Intron | Beginning | End |
| S | 201188 | 201234 | S | 201235 | 214675 |
| T | 214676 | 214793 | T | 214794 | 215701 |
| U | 215702 | 215746 | U | 215747 | 216835 |
| V | 216836 | 216915 | | | |

Thus, the invention embodies purified, isolated, or recombinant polynucleotides comprising a nucleotide sequence selected from the group consisting of the exons of the sbg2 gene, or a sequence complementary thereto. Preferred are purified, isolated, or recombinant polynucleotides comprising at least one exon having the nucleotide position ranges listed in Table 5f selected from the group consisting of the exons S, T, U and V of the sbg2 gene, or a complementary sequence thereto or a fragment or a variant thereof. Also encompassed by the invention are purified, isolated, or recombinant nucleic acids comprising a combination of at least two exons of the sbg2 gene selected from the group consisting of exons S, T, U and V, wherein the polynucleotides are arranged within the nucleic acid in the same relative order as in SEQ ID No. 1.

The present invention further embodies purified, isolated, or recombinant polynucleotides comprising a nucleotide sequence selected from the group consisting of the introns of the sbg2 gene, or a sequence complementary thereto. The position of the introns is detailed in Table 5f. Intron S refers to the nucleotide sequence located between Exon S and Exon T, and so on. Thus, the invention embodies purified, isolated, or recombinant polynucleotides comprising a nucleotide sequence selected from the group consisting of the 3 introns of the sbg2 gene, or a sequence complementary thereto.

The invention also encompasses a purified, isolated, or recombinant polynucleotide comprising a nucleotide sequence of sbg2 having at least 70, 75, 80, 85, 90, 95, 98 or 99% nucleotide identity with a sequence selected from the group consisting of nucleotide positions 201188 to 216915, 201188 to 201234, 214676 to 214793, 215702 to 215746 and 216836 to 216915 of SEQ ID No. 1 or a complementary sequence thereto or a fragment thereof. The nucleotide differences as regards the nucleotide positions 201188 to 216915, 201188 to 201234, 214676 to 214793, 215702 to 215746 and 216836 to 216915 of SEQ ID No. 1 may be generally randomly distributed throughout the entire nucleic acid.

Another object of the invention relates to purified, isolated or recombinant nucleic acids comprising a polynucleotide that hybridizes, under the stringent hybridization conditions defined herein, with a polynucleotide selected from the group consisting of nucleotide positions 201188 to 216915, 201188 to 201234, 214676 to 214793, 215702 to 215746 and 216836 to 216915 of SEQ ID No 1, or a sequence complementary thereto or a variant thereof or a biologically active fragment thereof.

Additional preferred nucleic acids of the invention include isolated, purified, or recombinant sbg2 polynucleotides comprising a contiguous span of at least 12, 15, 18, 20, 25, 30, 35, 40, 45, 50, 55, 60, 65, 70, 75, 80, 90, 100 or 200 nucleotides of nucleotide positions 201188 to 216915, 201188 to 201234, 214676 to 214793, 215702 to 215746 and 216836 to 216915 of SEQ ID No 1 or the complements thereof, wherein said contiguous span comprises an sbg2-related biallelic marker. Optionally, said biallelic marker is selected from the group consisting of A79 to A99. It should be noted that nucleic acid fragments of any size and sequence may also be comprised by the polynucleotides described in this section. Either the original or the alternative allele may be present at said biallelic marker.

An sbg2 polynucleotide or gene may further contain regulatory sequences both in the non-coding 5'-flanking region and in the non-coding 3'-flanking region that border the region containing said genes or exons. Polynucleotides derived from 5' and 3' regulatory regions are useful in order to detect the presence of at least a copy of a nucleotide sequence comprising an sbg2 nucleotide sequence of SEQ ID No. 1 or a fragment thereof in a test sample. Polynucleotides carrying the regulatory elements located at the 5' end and at the 3' end of the genes comprising the exons of the present invention may be advantageously used to control the transcriptional and translational activity of a heterologous polynucleotide of interest.

While this section is entitled "sbg2 cDNA Sequences," it should be noted that nucleic acid fragments of any size and sequence may also be comprised by the polynucleotides described in this section, flanking the genomic sequences of sbg2 on either side or between two or more such genomic sequences.

Polynucleotide Constructs

The terms "polynucleotide construct" and "recombinant polynucleotide" are used interchangeably herein to refer to linear or circular, purified or isolated polynucleotides that have been artificially designed and which comprise at least two nucleotide sequences that are not found as contiguous nucleotide sequences in their initial natural environment. It should be noted that the present invention embodies recombinant vectors comprising any one of the polynucleotides described in the present invention.

DNA Constructs that Enables Directing Temporal and Spatial Expression of sbg1, g34665, sbg2, g35017 and g35018 Nucleic Acid Sequences in Recombinant Cell Hosts and in Transgenic Animals In order to study the physiological and phenotypic consequences of a lack of synthesis of a protein encoded by a nucleotide sequence comprising an sbg1, g34665, sbg2, g35017 or g35018 polynucleotide, both at the cell level and at the multi cellular organism level, the invention also encompasses DNA constructs and recombinant vectors enabling a conditional expression of a specific allele of a nucleotide sequence comprising an sbg1, g34665, sbg2, g35017 or g35018 polynucleotide and also of a copy of a sequence comprising a nucleotide sequence of an sbg1, g34665, sbg2, g35017 or g35018 polynucleotide, or a fragment thereof, harboring substitutions, deletions, or additions of one or more bases. These base substitutions, deletions or additions may be located either in an exon, an intron or a regulatory sequence, in particular a 5' regulatory sequence of an sbg1, g34665, sbg2, g35017 or g35018 polynucleotide. In a preferred embodiment, the nucleotide sequence comprising an sbg1, g34665, sbg2, g35017 or g35018 polynucleotide further comprises a biallelic marker of the present invention.

A first preferred DNA construct is based on the tetracycline resistance operon tet from E. coli transposon Tn110 for controlling the expression of an sbg1, g34665, sbg2, g35017 or g35018 polynucleotide, such as described by Gossen et al. (1992, 1995) and Furth et al. (1994), the disclosures of which are incorporated herein by reference. Such a DNA construct contains seven tet operator sequences from Tn10 (tetop) that are fused to either a minimal promoter or a 5'-regulatory sequence of the sbg1, g34665, sbg2, g35017 or g35018 polynucleotide, said minimal promoter or said sbg1, g34665, sbg2, g35017 or g35018 polynucleotide regulatory sequence being operably linked to a polynucleotide of interest that codes either for a sense or an antisense oligonucleotide or for a polypeptide, including an sbg1, g34665, sbg2, g35017 or g35018 polynucleotide-encoded polypeptide or a peptide fragment thereof. This DNA construct is functional as a conditional expression system for the nucleotide sequence of interest when the same cell also comprises a nucleotide sequence coding for either the wild type (tTA) or the mutant (rTA) repressor fused to the activating domain of viral protein VP16 of herpes simplex virus, placed under the control of a promoter, such as the HCMVIE1 enhancer/promoter or the MMTV-LTR. Indeed, a preferred DNA construct of the invention comprises both the polynucleotide containing the tet operator sequences and the polynucleotide containing a sequence coding for the tTA or the rTA repressor.

In a specific embodiment, the conditional expression DNA construct contains the sequence encoding the mutant tetracycline repressor rTA, the expression of the polynucleotide of interest is silent in the absence of tetracycline and induced in its presence.

DNA Constructs Allowing Homologous Recombination: Replacement Vectors

A second preferred DNA construct will comprise, from 5'-end to 3'-end: (a) a first nucleotide sequence comprising an sbg1 polynucleotide; (b) a nucleotide sequence comprising a positive selection marker, such as the marker for neomycine resistance (neo); and (c) a second nucleotide sequence comprising a respective sbg1 polynucleotide, and is located on the genome downstream of the first sbg1 polynucleotide sequence (a). Also encompassed are DNA construct prepared in an analogous manner using g34665, sbg2, g35017 or g35018 nucleotide sequences in place of the sbg1 sequences described above.

In a preferred embodiment, this DNA construct also comprises a negative selection marker located upstream the nucleotide sequence (a) or downstream the nucleotide sequence (c). Preferably, the negative selection marker comprises the thymidine kinase (tk) gene (Thomas et al., 1986), the hygromycine beta gene (Te Riele et al., 1990), the hprt gene (Van der Lugt et al., 1991; Reid et al., 1990) or the Diphteria toxin A fragment (Dt-A) gene (Nada et al., 1993; Yagi et al. 1990), the disclosures of which are incorporated herein by reference. Preferably, the positive selection marker is located within and exon of an sbg1, g34665, sbg2, g35017 or g35018 polynucleotide so as to interrupt the sequence encoding the sbg1, g34665, sbg2, g35017 or g35018 protein. These replacement vectors are described, for example, by Thomas et al. (1986; 1987), Mansour et al. (1988) and Koller et al. (1992), the disclosures of which are incorporated herein by reference.

The first and second nucleotide sequences (a) and (c) may be indifferently located within an sbg1, g34665, sbg2, g35017 or g35018 polynucleotide regulatory sequence, an intronic sequence, an exon sequence or a sequence containing both regulatory and/or intronic and/or exon sequences. The size of the nucleotide sequence of (a) and (c) ranges from 1 to 50 kb, preferably from 1 to 10 kb, more preferably from 2 to 6 kb and most preferably from 2 to 4 kb.

DNA Constructs Allowing Homologous Recombination: Cre-LoxP System.

These new DNA constructs make use of the site specific recombination system of the P1 phage. The P1 phage possesses a recombinase called Cre which interacts specifically with a base pairs loxP site. The loxP site is composed of two palindromic sequences of 13 bp separated by a 8 bp conserved sequence (Hoess et al., 1986, the disclosure of which is incorporated herein by reference). The recombination by the Cre enzyme between two loxP sites having an identical orientation leads to the deletion of the DNA fragment.

The Cre-loxP system used in combination with a homologous recombination technique has been first described by Gu et al. (1993, 1994), the disclosures of which are incorporated herein by reference. Briefly, a nucleotide sequence of interest to be inserted in a targeted location of the genome harbors at least two loxP sites in the same orientation and located at the respective ends of a nucleotide sequence to be excised from the recombinant genome. The excision event requires the presence of the recombinase (Cre) enzyme within the nucleus of the recombinant cell host. The recombinase enzyme may be brought at the desired time either by (a) incubating the recombinant cell hosts in a culture medium containing this enzyme, by injecting the Cre enzyme directly into the desired cell, such as described by Araki et al. (1995), or by lipofection of the enzyme into the cells, such as described by Baubonis et al. (1993), the disclosures of which are incorporated herein by reference; (b) transfecting the cell host with a vector comprising the Cre coding sequence operably linked to a promoter functional in the recombinant cell host, which promoter being optionally inducible, said vector being introduced in the recombinant cell host, such as described by Gu et al. (1993) and Sauer et al. (1988), the disclosures of which are incorporated herein by reference; (c) introducing in the genome of the cell host a polynucleotide comprising the Cre coding sequence operably linked to a promoter functional in the recombinant cell host, which promoter is optionally inducible, and said polynucleotide being inserted in the genome of the cell host either by a random insertion event or an homologous recombination event, such as described by Gu et al. (1993).

In a specific embodiment, the vector containing the sequence to be inserted in an sbg1, g34665, sbg2, g35017 or g35018 gene sequence by homologous recombination is constructed in such a way that selectable markers are flanked by loxP sites of the same orientation, it is possible, by treatment by the Cre enzyme, to eliminate the selectable markers while leaving the sbg1, g34665, sbg2, g35017 or g35018 polynucleotide sequences of interest that have been inserted by an homologous recombination event. Again, two selectable markers are needed: a positive selection marker to select for the recombination event and a negative selection marker to select for the homologous recombination event. Vectors and methods using the Cre-loxP system are described by Zou et al. (1994), the disclosure of which is incorporated herein by reference.

Thus, in one aspect, a further preferred DNA construct of the invention comprises, from 5'-end to 3'-end: (a) a first nucleotide sequence that is comprised by an sbg1 polynucleotide; (b) a nucleotide sequence comprising a polynucleotide encoding a positive selection marker, said nucleotide sequence comprising additionally two sequences defining a site recognized by a recombinase, such as a loxP site, the two sites being placed in the same orientation; and (c) a second nucleotide sequence comprising an sbg1 polynucleotide, and is located on the genome downstream of the first sbg1 polynucleotide sequence (a). Also encompassed are DNA construct prepared in an analogous manner using g34665, sbg2, g35017 or g35018 nucleotide sequences in place of the sbg1 sequences described above.

The sequences defining a site recognized by a recombinase, such as a loxP site, are preferably located within the nucleotide sequence (b) at suitable locations bordering the nucleotide sequence for which the conditional excision is sought. In one specific embodiment, two loxp sites are located at each side of the positive selection marker sequence, in order to allow its excision at a desired time after the occurrence of the homologous recombination event.

In a preferred embodiment of a method using the third DNA construct described above, the excision of the polynucleotide fragment bordered by the two sites recognized by a recombinase, preferably two loxP sites, is performed at a desired time, due to the presence within the genome of the recombinant host cell of a sequence encoding the Cre enzyme operably linked to a promoter sequence, preferably an inducible promoter, more preferably a tissue-specific promoter sequence and most preferably a promoter sequence which is both inducible and tissue-specific, such as described by Gu et al. (1993).

The presence of the Cre enzyme within the genome of the recombinant cell host may result from the breeding of two transgenic animals, the first transgenic animal bearing the sbg1, g34665, sbg2, g35017 or g35018 polynucleotide-derived sequence of interest containing the loxP sites as described above and the second transgenic animal bearing the Cre coding sequence operably linked to a suitable promoter sequence, such as described by Gu et al. (1993).

Spatio-temporal control of the Cre enzyme expression may also be achieved with an adenovirus based vector that contains the Cre gene thus allowing infection of cells, or in vivo infection of organs, for delivery of the Cre enzyme, such as described by Anton et al. (1995) and Kanegae et al. (1995), the disclosures of which are incorporated herein by reference.

The DNA constructs described above may be used to introduce a desired nucleotide sequence of the invention, preferably an sbg1, g34665, sbg2, g35017 or g35018 polynucleotide, and most preferably an altered copy an sbg1, g34665, sbg2, g35017 or g35018 polynucleotide sequence, within a predetermined location of the targeted genome, leading either to the generation of an altered copy of a targeted gene (knock-out homologous recombination) or to the replacement of a copy of the targeted gene by another copy sufficiently homologous to allow an homologous recombination event to occur (knock-in homologous recombination). In a specific embodiment, the DNA constructs described above may be used to introduce an sbg1, g34665, sbg2, g35017 or g35018 polynucleotide.

Nuclear Antisense DNA Constructs

Other compositions containing a vector of the invention comprise an oligonucleotide fragment of the sbg1, g34665, sbg2, g35017 or g35018 polynucleotide sequences of SEQ ID No. 1 respectively, as an antisense tool that inhibits the expression of the corresponding gene. Preferred methods using antisense polynucleotide according to the present invention are the procedures described by Sczakiel et al.

(1995) or those described in PCT Application No WO 95/24223, the disclosures of which are incorporated herein by reference.

Preferably, the antisense tools are chosen among the polynucleotides (15–200 bp long) that are complementary to the 5end of an sbg1, g34665, sbg2, g35017 or g35018 polynucleotide mRNA. In one embodiment, a combination of different antisense polynucleotides complementary to different parts of the desired targeted gene are used.

Preferably, the antisense polynucleotides of the invention have a 3' polyadenylation signal that has been replaced with a self-cleaving ribozyme sequence, such that RNA polymerase II transcripts are produced without poly(A) at their 3' ends, these antisense polynucleotides being incapable of export from the nucleus, such as described by Liu et al. (1994), the disclosure of which is incorporated herein by reference. In a preferred embodiment, these sbg1, g34665, sbg2, g35017 or g35018 antisense polynucleotides also comprise, within the ribozyme cassette, a histone stem-loop structure to stabilize cleaved transcripts against 3'-5' exonucleolytic degradation, such as the structure described by Eckner et al. (1991), the disclosure of which is incorporated herein by reference.

Oligonucleotide Probes and Primers

The polynucleotides of the invention are useful in order to detect the presence of at least a copy of a nucleotide sequence of SEQ ID No. 1 or of the respective sbg1, g34665, sbg2, g35017 and g35018 polynucleotide or gene, or a fragment, complement, or variant thereof in a test sample.

Particularly preferred probes and primers of the invention include isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides, to the extent that said span is consistent with the length of the nucleotide position range, of SEQ ID No 1, wherein said contiguous span comprises at least 1, 2, 3, 4, 5, 7 or 10 of the following nucleotide positions of SEQ ID No 1:

(a) nucleotide positions 31 to 292651 and 292844 to 319608;

(b) 290653 to 292652, 292653 to 296047, 292653 to 292841, 295555 to 296047, 295580 to 296047 and 296048 to 298048;

(c) 94124 to 94964;

(d) 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854;

(e) 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685;

(f) 201188 to 216915, 201188 to 201234, 214676 to 214793, 215702 to 215746 and 216836 to 216915; or (g) a complementary sequence thereto or a fragment thereof.

Probes and primers of the invention also include isolated, purified, or recombinant polynucleotides having at least 70, 75, 80, 85, 90, or 95% nucleotide identity with a contiguous span of at least 12, 15, 18, 20, 25, 30, 35, 40, 50, 60, 70, 80, 90, 100, 150, 200, 500, 1000 or 2000 nucleotides of nucleotide positions 31 to 292651 and 292844 to 319608 of SEQ ID No. 1. Preferred probes and primers of the invention also include isolated, purified, or recombinant polynucleotides comprising an sbg1, g34665, sbg2, g35017 or g35018 nucleotide sequence having at least 70, 75, 80, 85, 90, or 95% nucleotide identity with at least one sequence selected from the group consisting of the following nucleotide positions of SEQ ID No. 1:

(a) 290653 to 292652, 292653 to 296047, 292653 to 292841, 295555 to 296047, 295580 to 296047 and 296048 to 298048;

(b) 94124 to 94964;

(c) 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854;

(d) 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685;

(e) 201188 to 216915, 201188 to 201234, 214676 to 214793, 215702 to 215746 and 216836 to 216915; or (f) a complementary sequence thereto or a fragment thereof.

Another set of probes and primers of the invention include isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides of SEQ ID No. 1 or the complements thereof, wherein said contiguous span comprises at least 1, 2, 3, 5, or 10 nucleotide positions of any one of the ranges of nucleotide positions, designated pos1 to pos166, of SEQ ID No. 1 listed in Table 1 above.

The invention also relates to nucleic acid probes characterized in that they hybridize specifically, under the stringent hybridization conditions defined above, with a contiguous span of at least 12, 15, 18, 20, 25, 30, 35, 40, 50, 60, 70, 80, 90, 100, 150, 200, 500, 1000 or 2000 nucleotides of nucleotide positions 31 to 292651 and 292844 to 319608 of SEQ ID No. 1, or a variant thereof or a sequence complementary thereto. Particularly preferred are nucleic acid probes characterized in that they hybridize specifically, under the stringent hybridization conditions defined above, with a nucleic acid selected from the group consisting of nucleotide positions:

(a) 290653 to 292652, 292653 to 296047, 292653 to 292841, 295555 to 296047, 295580 to 296047 and 296048 to 298048;

(b) 94124 to 94964;

(c) 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854;

(d) 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685;

(e) 201188 to 216915, 201188 to 201234, 214676 to 214793, 215702 to 215746 and 216836 to 216915; or (f) a complementary sequence thereto or a fragment thereof.

The formation of stable hybrids depends on the melting temperature (Tm) of the DNA. The Tm depends on the length of the primer or probe, the ionic strength of the solution and the G+C content. The higher the G+C content of the primer or probe, the higher is the melting temperature because G:C pairs are held by three H bonds whereas A:T pairs have only two. The GC content in the probes of the invention usually ranges between 10 and 75%, preferably between 35 and 60%, and more preferably between 40 and 55%.

A probe or a primer according to the invention may be between 8 and 2000 nucleotides in length, or is specified to be at least 12, 15, 18, 20, 25, 35, 40, 50, 60, 70, 80, 100, 250, 500, 1000 nucleotides in length. More particularly, the length of these probes can range from 8, 10, 15, 20, or 30 to 100 nucleotides, preferably from 10 to 50, more preferably from 15 to 30 nucleotides. Shorter probes tend to lack specificity for a target nucleic acid sequence and generally require cooler temperatures to form sufficiently stable hybrid complexes with the template. Longer probes are expensive to produce and can sometimes self-hybridize to form hairpin structures. The appropriate length for primers and probes under a particular set of assay conditions may be empirically determined by one of skill in the art.

The primers and probes can be prepared by any suitable method, including, for example, cloning and restriction of appropriate sequences and direct chemical synthesis by a method such as the phosphodiester method of Narang et al. (1979), the phosphodiester method of Brown et al. (1979), the diethylphosphoramidite method of Beaucage et al. (1981) and the solid support method described in EP 0 707 592. The disclosures of all these documents are incorporated herein by reference.

Detection probes are generally nucleic acid sequences or uncharged nucleic acid analogs such as, for example peptide nucleic acids which are disclosed in International Patent Application WO 92/20702, morpholino analogs which are described in U.S. Pat. Nos. 5,185,444; 5,034,506 and 5,142,047, the disclosures of which are all incorporated herein by reference. The probe may have to be rendered "non-extendable" in that additional dNTPs cannot be added to the probe. In and of themselves analogs usually are non-extendable and nucleic acid probes can be rendered non-extendable by modifying the 3' end of the probe such that the hydroxyl group is no longer capable of participating in elongation. For example, the 3' end of the probe can be functionalized with the capture or detection label to thereby consume or otherwise block the hydroxyl group. Alternatively, the 3' hydroxyl group simply can be cleaved, replaced or modified; U.S. patent application Ser. No. 07/049,061 filed Apr. 19, 1993, incorporated herein by reference, describes modifications which can be used to render a probe non-extendable.

Any of the polynucleotides of the present invention can be labeled, if desired, by incorporating a label detectable by spectroscopic, photochemical, biochemical, immunochemical, or chemical means. For example, useful labels include radioactive substances ($^{32}P$, $^{35}S$, $^{3}H$, $^{125}I$), fluorescent dyes (5-bromodesoxyuridin, fluorescein, acetylaminofluorene, digoxigenin) or biotin. Preferably, polynucleotides are labeled at their 3' and 5' ends. Examples of non-radioactive labeling of nucleic acid fragments are described in the French patent No. FR-7810975 or by Urdea et al (1988) or Sanchez-Pescador et al (1988), each incorporated herein by reference. In addition, the probes according to the present invention may have structural characteristics such that they allow the signal amplification, such structural characteristics being, for example, branched DNA probes as those described by Urdea et al. in 1991 or in the European patent No. EP 0 225 807 (Chiron), incorporated herein by reference.

A label can also be used to capture the primer, so as to facilitate the immobilization of either the primer or a primer extension product, such as amplified DNA, on a solid support. A capture label is attached to the primers or probes and can be a specific binding member which forms a binding pair with the solid phase reagent's specific binding member (e.g. biotin and streptavidin). Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleic acid sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleic acid on a solid phase. DNA Labeling techniques are well known to the skilled technician.

The probes of the present invention are useful for a number of purposes. They can be notably used in Southern hybridization to genomic DNA. The probes can also be used to detect PCR amplification products. They may also be used to detect mismatches in a sequence comprising a polynucleotide of SEQ ID Nos 1 to 26, 36 to 40 and 54 to 229, or an sbg1, g34665, sbg2, g35017 or g35018 polynucleotide or gene or mRNA using other techniques.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleic acids on solid phases include ionic, hydrophobic, covalent interactions and the like. A solid support, as used herein, refers to any material which is insoluble, or can be made insoluble by a subsequent reaction. The solid support can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the invention to a single solid support. In addition, polynucleotides other than those of the invention may be attached to the same solid support as one or more polynucleotides of the invention.

Consequently, the invention also comprises a method for detecting the presence of a nucleic acid comprising a nucleotide sequence selected from a group consisting of SEQ ID Nos. 1 to 26, 36 to 40 and 54 to 229, a fragment or a variant thereof or a complementary sequence thereto in a sample, said method comprising the following steps of:

a) bringing into contact a nucleic acid probe or a plurality of nucleic acid probes which can hybridize with a nucleotide sequence included in a nucleic acid selected form the group consisting of the nucleotide sequences of SEQ ID Nos. 1 to 26, 36 to 40 and 54 to 229, a fragment or a variant thereof or a complementary sequence thereto and the sample to be assayed; and b) detecting the hybrid complex formed between the probe and a nucleic acid in the sample.

The invention further concerns a kit for detecting the presence of a nucleic acid comprising a nucleotide sequence selected from a group consisting of SEQ ID Nos. 1 to 26, 36 to 40 and 54 to 229, a fragment or a variant thereof or a complementary sequence thereto in a sample, said kit comprising:

a) a nucleic acid probe or a plurality of nucleic acid probes which can hybridize with a nucleotide sequence included in a nucleic acid selected form the group consisting of the nucleotide sequences of SEQ ID Nos. 1 to 26, 36 to 40 and 54 to 229, a fragment or a variant thereof or a complementary sequence thereto; and b) optionally, the reagents necessary for performing the hybridization reaction.

In a first preferred embodiment of this detection method and kit, said nucleic acid probe or the plurality of nucleic acid probes are labeled with a detectable molecule. In a second preferred embodiment of said method and kit, said nucleic acid probe or the plurality of nucleic acid probes has been immobilized on a substrate. In a third preferred embodiment, the nucleic acid probe or the plurality of nucleic acid probes comprise either a sequence which is selected from the group consisting of the nucleotide sequences of P1 to P360 and the complementary sequence thereto, B1 to B229, C1 to C229, D1 to D360, E1 to E360, or a nucleotide sequence comprising a biallelic marker selected from the group consisting of A1 to A360 or a polymorphism selected from the group consisting of A361 to A489, or the complements thereto.

Oligonucleotide Arrays

A substrate comprising a plurality of oligonucleotide primers or probes of the invention may be used either for detecting or amplifying targeted sequences in a nucleotide sequence of SEQ ID No. 1, more particularly in an sbg1, g34665, sbg2, g35017 or g35018 polynucleotide, or in genes comprising an sbg1, g34665, sbg2, g35017 or g35018 polynucleotide and may also be used for detecting mutations in the coding or in the non-coding sequences of an sbg1, g34665, sbg2, g35017 or g35018 nucleic acid sequence, or genes comprising an sbg1, g34665, sbg2, g35017 or g35018 nucleic acid sequence.

Any polynucleotide provided herein may be attached in overlapping areas or at random locations on the solid support. Alternatively the polynucleotides of the invention may be attached in an ordered array wherein each polynucleotide is attached to a distinct region of the solid support which does not overlap with the attachment site of any other polynucleotide. Preferably, such an ordered array of polynucleotides is designed to be "addressable" where the distinct locations are recorded and can be accessed as part of an assay procedure. Addressable polynucleotide arrays typically comprise a plurality of different oligonucleotide probes that are coupled to a surface of a substrate in different known locations. The knowledge of the precise location of each polynucleotides location makes these "addressable" arrays particularly useful in hybridization assays. Any addressable array technology known in the art can be employed with the polynucleotides of the invention. One particular embodiment of these polynucleotide arrays is known as Genechips™, and has been generally described in U.S. Pat. No. 5,143,854; PCT publications WO 90/15070 and 92/10092, the disclosures of which are incorporated herein by reference. These arrays may generally be produced using mechanical synthesis methods or light directed synthesis methods which incorporate a combination of photolithographic methods and solid phase oligonucleotide synthesis (Fodor et al., 1991, incorporated herein by reference). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854; and 5,412,087 and in PCT Publications WO 90/15070, WO 92/10092 and WO 95/11995, each of which are incorporated herein by reference, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256, the disclosures of which are incorporated herein by reference in their entireties.

In another embodiment of the oligonucleotide arrays of the invention, an oligonucleotide probe matrix may advantageously be used to detect mutations occurring in an sbg1, g34665, sbg2, g35017 or g35018 polynucleotide, including in genes comprising an sbg1, g34665, sbg2, g35017 or g35018 polynucleotide and preferably in an sbg1, g34665, sbg2, g35017 or g35018 polynucleotide regulatory region. For this particular purpose, probes are specifically designed to have a nucleotide sequence allowing their hybridization to the genes that carry known mutations (either by deletion, insertion or substitution of one or several nucleotides). By known mutations in an sbg1, g34665, sbg2, g35017 or g35018 polynucleotide, it is meant, mutations in an sbg1, g34665, sbg2, g35017 or g35018 polynucleotide that have been identified according; the technique used by Huang et al. (1996) or Samson et al. (1996), each incorporated herein by reference, for example, may be used to identify such mutations.

Another technique that is used to detect mutations in an sbg1, g34665, sbg2, g35017 or g35018 polynucleotide is the use of a high-density DNA array. Each oligonucleotide probe constituting a unit element of the high density DNA array is designed to match a specific subsequence of an sbg1, g34665, sbg2, g35017 or g35018 polynucleotide. Thus, an array consisting of oligonucleotides complementary to subsequences of the target gene sequence is used to determine the identity of the target sequence with the wild-type gene sequence, measure its amount, and detect differences between the target sequence and the reference wild-type nucleic acid sequence of an sbg1, g34665, sbg2, g35017 or g35018 polynucleotide. In one such design, termed 4L tiled array, is implemented a set of four probes (A, C, G, T), preferably 15-nucleotide oligomers. In each set of four probes, the perfect complement will hybridize more strongly than mismatched probes. Consequently, a nucleic acid target of length L is scanned for mutations with a tiled array containing 4L probes, the whole probe set containing all the possible mutations in the known wild reference sequence. The hybridization signals of the 15-mer probe set tiled array are perturbed by a single base change in the target sequence. As a consequence, there is a characteristic loss of signal or a "footprint" for the probes flanking a mutation position. This technique was described by Chee et al. in 1996, which is herein incorporated by reference.

Consequently, the invention concerns an array of nucleic acid molecules comprising at least one polynucleotide described above as probes and primers. Preferably, the invention concerns an array of nucleic acid comprising at least two polynucleotides described above as probes and primers.

Sbg1, g34665, sbg2, g35017 and g35018 Proteins and Polypeptide Fragments

The terms "sbg1 polypeptides", "g34665 polypeptides", "sbg2 polypeptides", "g35017 polypeptides", "g35017 polypeptides" are used herein to embrace all of the proteins and polypeptides encoded by the respective sbg1, g34665, sbg2, g35017 and g35018 polypeptides of the present invention. Forming part of the invention are polypeptides encoded by the polynucleotides of the invention, as well as fusion polypeptides comprising such polypeptides. The invention embodies proteins from humans, mammals, primates, non-human primates, and includes isolated or purified sbg1 proteins consisting, consisting essentially, or comprising the sequence of SEQ ID Nos 27 to 35, isolated or purified g34665, g35017 and sbg2 proteins encoded by the g34665, g35017 and sbg2 polynucleotide sequence of SEQ ID No 1, and isolated or purified g35018 proteins consisting, consisting essentially, or comprising the sequence of SEQ ID Nos 41 to 43.

It should be noted that the sbg1, g34665, sbg2, g35017 and g35018 proteins of the invention also comprise naturally-occurring variants of the amino acid sequence of the respective human sbg1, g34665, sbg2, g35017 and g35018 proteins.

The present invention embodies isolated, purified, and recombinant polypeptides comprising a contiguous span of at least 4 amino acids, preferably at least 6, more preferably at least 8 to 10 amino acids, more preferably at least 12, 15, 20, 25, 30, 40, 50, or 100 amino acids, to the extent that said span is consistent with the length of a particular SEQ ID, of SEQ ID Nos 27 to 35 and 41 to 43. In other preferred embodiments the contiguous stretch of amino acids comprises the site of a mutation or functional mutation, including a deletion, addition, swap or truncation of the amino acids in an sbg1, g34665, sbg2, g35017 and g35018 protein sequence.

The invention also embodies isolated, purified, and recombinant sbg1 polypeptides comprising a contiguous span of at least 4 amino acids, preferably at least 6 or at least 8 to 10 amino acids, more preferably at least 12, 15, 20, 25, 30, 40, 50, or 100 amino acids of SEQ ID Nos 27 to 35, wherein said contiguous span comprises an amino acid variation according to Table 5e.

The present inventors have further identified potential cleavage sites in the sbg1 polypeptides, and several specific sbg1 peptides. An sbg1 peptide has further been tested in behavioral studies by injection in mice, as further detailed in Example 7. In particular, the polypeptide of SEQ ID No 29 contains a protease cleavage site at amino acid positions 62 to 63; the polypeptide of SEQ ID No 30 contains a protease cleavage site at amino acid positions 63 to 64 and 110 to 111; the polypeptide of SEQ ID No 32 contains a protease cleavage site at amino acid positions 63 to 64; the polypeptide of SEQ ID No 33 contains a protease cleavage site at amino acid positions 54 to 55 and 57 to 58; the polypeptide of SEQ ID No 34 contains a protease cleavage site at amino acid positions 63 to 64 and 122 to 123; and the polypeptide of SEQ ID No 35 contains a protease cleavage site at amino acid positions 62 to 63 and 63 to 64. Additionally, sbg1 polypeptides of SEQ ID Nos 30, 32 and 34 contain cysteine residues predicted to be capable of forming a disulfide bridge at amino acid positions 82 and 104 of SEQ ID No 30, amino acid positions 82 and 106 and SEQ ID No 32, and amino acid positions 132 and 142 of SEQ ID No 34. In particularly preferred embodiment, the invention comprises isolated, purified, and recombinant sbg1 peptides comprising a contiguous span of at least 4 amino acids, preferably at least 6 or at least 8 to 10 amino acids, more preferably at least 12 or 15 amino acids of an amino acid position range selected from the group consisting of amino acid positions: 1 to 63 and 64 to 102 of SEQ ID No 29; 1 to 64, 65 to 111 and 112 to 119 of SEQ ID No 30; 1 to 64 and 65 to 126 of SEQ ID No 32; 1 to 64, 65 to 123 and 124 to 153 of SEQ ID No 34; and 1 to 61 and 65 to 106 of SEQ ID No 35.

The invention further embodies sbg1, g34665, sbg2, g35017 and g35018 polypeptides, including isolated and recombinant polypeptides, encoded respectively by sbg1, g34665, sbg2, g35017 and g35018 polynucleotides consisting, consisting essentially, or comprising a contiguous span of at least 12, 15, 18, 20, 25, 30, 35, 40, 50, 60, 70, 80, 90, 100, 150, 200 or 500 nucleotides, to the extent that the length of said span is consistent with the nucleotide position range, of SEQ ID No 1, wherein said contiguous span comprises at least 1, 2, 3, 4, 5, 7 or 10 of the following nucleotide positions of SEQ ID No 1:

(a) 290653 to 292652, 292653 to 296047, 292653 to 292841, 295555 to 296047 and 295580 to 296047;

(b) 94144 to 94964

(c) 1108 to 65853, 1108 to 1289, 14877 to 14920, 18778 to 18862, 25593 to 25740, 29388 to 29502, 29967 to 30282, 64666 to 64812, and 65505 to 65853;

(d) 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685 and 240800 to 240993;

(e) 201188 to 216915, 201188 to 201234, 214676 to 214793, 215702 to 215746 and 216836 to 216915; or the complements thereof.

The present invention further embodies isolated, purified, and recombinant polypeptides encoded by an sbg1 polynucleotide or gene comprising at least one sbg1 nucleotide sequence selected from the group consisting of the following sbg1 exons: MS1, M1, M692, M862, MS2, M1069, M1090, M1117, N, N2, Nbis, O, O1, O2, Obis, P, X, Q1, Q, Qbis, R and Rbis.

The invention also encompasses a purified, isolated, or recombinant polypeptides comprising an amino acid sequence having at least 70, 75, 80, 85, 90, 95, 98 or 99% amino acid identity with the amino acid sequence of SEQ ID Nos 27 to 35 and 41 to 43 or a fragment thereof.

Sbg1, g34665, sbg2, g35017 and g35018 proteins are preferably isolated from human or mammalian tissue samples or expressed from human or mammalian genes. The sbg1, g34665, sbg2, g35017 and g35018 polypeptides of the invention can be made using routine expression methods known in the art. The polynucleotide encoding the desired polypeptide, is ligated into an expression vector suitable for any convenient host. Both eukaryotic and prokaryotic host systems is used in forming recombinant polypeptides, and a summary of some of the more common systems. The polypeptide is then isolated from lysed cells or from the culture medium and purified to the extent needed for its intended use. Purification is by any technique known in the art, for example, differential extraction, salt fractionation, chromatography, centrifugation, and the like. See, for example, Methods in Enzymology for a variety of methods for purifying proteins.

In addition, shorter protein fragments can be produced by chemical synthesis. Alternatively the proteins of the invention is extracted from cells or tissues of humans or non-human animals. Methods for purifying proteins are known in the art, and include the use of detergents or chaotropic agents to disrupt particles followed by differential extraction and separation of the polypeptides by ion exchange chromatography, affinity chromatography, sedimentation according to density, and gel electrophoresis.

Any sbg1, g34665, sbg2, g35017 or g35018 cDNA or fragment thereof, including the respective cDNA sequences of SEQ ID Nos 2 to 26 and 36 to 40 is used to express sbg1, g34665, sbg2, g35017 or g35018 proteins and polypeptides. The nucleic acid encoding the sbg1, g34665, sbg2, g35017 or g35018 protein or polypeptide to be expressed is operably linked to a promoter in an expression vector using conventional cloning technology. The sbg1, g34665, sbg2, g35017 or g35018 insert in the expression vector may comprise the full coding sequence for the respective sbg1, g34665, sbg2, g35017 or g35018 protein or a portion thereof. For example, the sbg1 or g35018 derived insert may encode a polypeptide comprising at least 10 consecutive amino acids of the respective sbg1 or g35018 protein of SEQ ID Nos 27 to 35 and 41 to 43.

The expression vector is any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence is optimized for the particular expression organism in which the expression vector is introduced, as explained by Hatfield, et al., U.S. Pat. No. 5,082,767, the disclosures of which are incorporated by reference herein in their entirety.

In one embodiment, the entire coding sequence of the sbg1, g34665, sbg2, g35017 or g35018 cDNA through the poly A signal of the cDNA are operably linked to a promoter in the expression vector. Alternatively, if the nucleic acid encoding a portion of the sbg1, g34665, sbg2, g35017 or g35018 protein lacks a methionine to serve as the initiation site, an initiating methionine can be introduced next to the first codon of the nucleic acid using conventional techniques. Similarly, if the insert from the sbg1, g34665, sbg2, g35017 or g35018 cDNA lacks a poly A signal, this sequence can be added to the construct by, for example, splicing out the Poly A signal from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex Thymidine Kinase promoter and the selectable neomycin gene. The nucleic acid encoding the sbg1, g34665, sbg2, g35017 or g35018 protein or a portion thereof is obtained by PCR from a bacterial vector containing the a nucleotide sequence of an exon of an sbg1, g34665, sbg2, g35017 or g35018 gene as described herein and in SEQ ID No 1, or from an sbg1 or g35018 cDNA comprising a nucleic acid of SEQ ID No 2 to 26 and 36 to 40 using oligonucleotide primers complementary to the sbg1, g34665, sbg2, g35017 or g35018 nucleic acid or portion thereof and containing restriction endonuclease sequences for PstI incorporated into the 5' primer and BglII at the 5' end of the corresponding cDNA 3' primer, taking care to ensure that the sequence encoding the sbg1, g34665, sbg2, g35017 or g35018 protein or a portion thereof is positioned properly with respect to the poly A signal. The purified fragment obtained from the resulting PCR reaction is digested with PstI, blunt ended with an exonuclease, digested with BglII, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.).

Alternatively, the nucleic acids encoding the sbg1, g34665, sbg2, g35017 or g35018 protein or a portion thereof is cloned into pED6dpc2 (Genetics Institute, Cambridge, Mass.). The resulting pED6dpc2 constructs is transfected into a suitable host cell, such as COS 1 cells. Methotrexate resistant cells are selected and expanded.

The above procedures may also be used to express a mutant sbg1, g34665, sbg2, g35017 or g35018 protein responsible for a detectable phenotype or a portion thereof.

The expressed proteins are purified using conventional purification techniques such as ammonium sulfate precipitation or chromatographic separation based on size or charge. The protein encoded by the nucleic acid insert may also be purified using standard immunochromatography techniques. In such procedures, a solution containing the expressed sbg1, g34665, sbg2, g35017 or g35018 protein or portion thereof, such as a cell extract, is applied to a column having antibodies against the sbg1, g34665, sbg2, g35017 or g35018 protein or portion thereof is attached to the chromatography matrix. The expressed protein is allowed to bind the immunochromatography column. Thereafter, the column is washed to remove non-specifically bound proteins. The specifically bound expressed protein is then released from the column and recovered using standard techniques.

To confirm expression of the sbg1, g34665, sbg2, g35017 or g35018 protein or a portion thereof, the proteins expressed from host cells containing an expression vector containing an insert encoding the sbg1, g34665, sbg2, g35017 or g35018 protein or a portion thereof can be compared to the proteins expressed in host cells containing the expression vector without an insert. The presence of a band in samples from cells containing the expression vector with an insert which is absent in samples from cells containing the expression vector without an insert indicates that the sbg1, g34665, sbg2, g35017 or g35018 protein or a portion thereof is being expressed. Generally, the band will have the mobility expected for the sbg1, g34665, sbg2, g35017 or g35018 protein or portion thereof. However, the band may have a mobility different than that expected as a result of modifications such as glycosylation, ubiquitination, or enzymatic cleavage.

Antibodies capable of specifically recognizing the expressed sbg1, g34665, sbg2, g35017 or g35018 protein or a portion thereof are described below.

If antibody production is not possible, the nucleic acids encoding the sbg1, g34665, sbg2, g35017 or g35018 protein or a portion thereof is incorporated into expression vectors designed for use in purification schemes employing chimeric polypeptides. In such strategies the nucleic acid encoding the sbg1, g34665, sbg2, g35017 or g35018 protein or a portion thereof is inserted in frame with the gene encoding the other half of the chimera. The other half of the chimera is β-globin or a nickel binding polypeptide encoding sequence. A chromatography matrix having antibody to β-globin or nickel attached thereto is then used to purify the chimeric protein. Protease cleavage sites is engineered between the β-globin gene or the nickel binding polypeptide and the sbg1, g34665, sbg2, g35017 or g35018 protein or portion thereof. Thus, the two polypeptides of the chimera is separated from one another by protease digestion.

One useful expression vector for generating β-globin chimeric proteins is pSG5 (Stratagene), which encodes rabbit β-globin. Intron II of the rabbit β-globin gene facilitates splicing of the expressed transcript, and the polyadenylation signal incorporated into the construct increases the level of expression. These techniques are well known to those skilled in the art of molecular biology. Standard methods are published in methods texts such as Davis et al., (1986) and many of the methods are available from Stratagene, Life Technologies, Inc., or Promega. Polypeptide may additionally be produced from the construct using in vitro translation systems such as the In vitro Express™ Translation Kit (Stratagene).

Antibodies that Bind sbg1, g34665, sbg2, g35017 or g35018 Polypeptides of the Invention Any sbg1, g34665, sbg2, g35017 or g35018 polypeptide or whole protein may be used to generate antibodies capable of specifically binding to an expressed sbg1, g34665, sbg2, g35017 and g35018 protein or fragments thereof.

For an antibody composition to specifically bind to an sbg1, g34665, sbg2, g35017 or g35018 protein, it must demonstrate at least a 5%, 10%, 15%, 20%, 25%, 50%, or 100% greater binding affinity for full length sbg1, g34665, sbg2, g35017 or g35018 protein than for any full length protein in an ELISA, RIA, or other antibody-based binding assay. For an antibody composition to specifically bind to a variant sbg1, g34665, sbg2, g35017 or g35018 protein, it must demonstrate at least a 5%, 10%, 15%, 20%, 25%, 50%, or 100% greater binding affinity for the respective full length variant sbg1, g34665, sbg2, g35017 or g35018 protein than for the respective reference sbg1, g34665, sbg2, g35017 or g35018 full length protein in an ELISA, RIA, or other antibody-based binding assay.

One antibody composition of the invention is capable of specifically binding or specifically binds to the respective sbg1 or g35018 proteins of SEQ ID Nos 27 to 35 and 41 to 43. Other antibody compositions of the invention are capable of specifically binding or specifically bind to an sbg1, sbg2 or g35018 protein variant. Optionally said sbg1 protein variant may be a natural variant provided in Tables 5d or 5e.

In one embodiment, the invention concerns antibody compositions, either polyclonal or monoclonal, capable of selectively binding, or selectively bind to an epitope-containing a polypeptide comprising a contiguous span of at least 6 amino acids, preferably at least 8 to 10 amino acids, more preferably at least 12, 15, 20, 25, 30, 40, 50, or 100 amino acids of an sbg1, g34665, sbg2, g35017 or g35018 polypeptide.

The invention also concerns a purified or isolated antibody capable of specifically binding to a mutated sbg1, g34665, sbg2, g35017 or g35018 protein or to a fragment or variant thereof comprising an epitope of the mutated sbg1, g34665, sbg2, g35017 or g35018 protein. In another preferred embodiment, the present invention concerns an antibody capable of binding to a polypeptide comprising at least 10 consecutive amino acids of an sbg1, g34665, sbg2, g35017 or g35018 protein and including at least one of the amino acids which can be encoded by the trait causing mutations.

In a preferred embodiment, the invention concerns the use in the manufacture of antibodies of a polypeptide comprising a contiguous span of at least 6 amino acids, preferably at least 8 to 10 amino acids, more preferably at least 12, 15, 20, 25, 30, 40, 50, or 100 amino acids of any of SEQ ID Nos 27 to 35 and 41 to 43.

Non-human animals, and more particularly non-human mammals and non-human primates, whether wild-type or transgenic, which express a different species of sbg1, g34665, sbg2, g35017 or g35018 than the one to which antibody binding is desired, and animals which do not express sbg1, g34665, sbg2, g35017 or g35018 (i.e. an sbg1, g34665, sbg2, g35017 or g35018 knock out animal as described in herein) are particularly useful for preparing antibodies. sbg1, g34665, sbg2, g35017 or g35018 knock out animals will recognize all or most of the exposed regions of an sbg1, g34665, sbg2, g35017 or g35018 protein as foreign antigens, and therefore produce antibodies with a wider array of sbg1, g34665, sbg2, g35017 or g35018 epitopes. Moreover, smaller polypeptides with only 10 to 30 amino acids may be useful in obtaining specific binding to anyone of the sbg1, g34665, sbg2, g35017 or g35018 proteins. In addition, the humoral immune system of animals which produce a species of sbg1, g34665, sbg2, g35017 or g35018 that resembles the antigenic sequence will preferentially recognize the differences between the animal's native sbg1, g34665, sbg2, g35017 or g35018 species and the antigen sequence, and produce antibodies to these unique sites in the antigen sequence. Such a technique will be particularly useful in obtaining antibodies that specifically bind to any one of the sbg1, g34665, sbg2, g35017 or g35018 proteins.

Antibody preparations prepared according to either protocol are useful in quantitative immunoassays which determine concentrations of antigen-bearing substances in biological samples; they are also used semi-quantitatively or qualitatively to identify the presence of antigen in a biological sample.

The antibodies may also be used in therapeutic compositions for killing cells expressing the protein or reducing the levels of the protein in the body. Thus in one embodiment, the invention comprises the use of an antibody capable of specifically recognizing sbg1, g34665, sbg2, g35017 or g35018 for the treatment of schizophrenia or bipolar disorder.

The antibodies of the invention may be labeled by any one of the radioactive, fluorescent or enzymatic labels known in the art.

Consequently, the invention is also directed to a method for detecting specifically the presence of an sbg1, g34665, sbg2, g35017 or g35018 polypeptide according to the invention in a biological sample, said method comprising the following steps:

a) bringing into contact the biological sample with a polyclonal or monoclonal antibody that specifically binds an sbg1, g34665, sbg2, g35017 or g35018 polypeptide, or to a peptide fragment or variant thereof, and b) detecting the antigen-antibody complex formed.

The invention also concerns a diagnostic kit for detecting in vitro the presence of an sbg1, g34665, sbg2, g35017 or g35018 polypeptide according to the present invention in a biological sample, wherein said kit comprises:

a) a polyclonal or monoclonal antibody that specifically binds an sbg1, g34665, sbg2, g35017 or g35018 polypeptide, or to a peptide fragment or variant thereof, optionally labeled;

b) a reagent allowing the detection of the antigen-antibody complexes formed, said reagent carrying optionally a label, or being able to be recognized itself by a labeled reagent, more particularly in the case when the above-mentioned monoclonal or polyclonal antibody is not labeled by itself.

Biallelic Markers of the Inventions

Advantages of the Biallelic Markers of the Present Invention

The biallelic marker of the inventions of the present invention offer a number of important advantages over other genetic markers such as RFLP (Restriction fragment length polymorphism) and VNTR (Variable Number of Tandem Repeats) markers.

The first generation of markers, were RFLPs, which are variations that modify the length of a restriction fragment. But methods used to identify and to type RFLPs are relatively wasteful of materials, effort, and time. The second generation of genetic markers were VNTRs, which can be categorized as either minisatellites or microsatellites. Minisatellites are tandemly repeated DNA sequences present in units of 5–50 repeats which are distributed along regions of the human chromosomes ranging from 0.1 to 20 kilobases in length. Since they present many possible alleles, their informative content is very high. Minisatellites are scored by performing Southern blots to identify the number of tandem repeats present in a nucleic acid sample from the individual being tested. However, there are only $10^4$ potential VNTRs that can be typed by Southern blotting. Moreover, both RFLP and VNTR markers are costly and time-consuming to develop and assay in large numbers.

Single nucleotide polymorphism or biallelic markers can be used in the same manner as RFLPs and VNTRs but offer several advantages. Single nucleotide polymorphisms are densely spaced in the human genome and represent the most frequent type of variation. An estimated number of more than $10^7$ sites are scattered along the $3 \times 10^9$ base pairs of the human genome. Therefore, single nucleotide polymorphism occur at a greater frequency and with greater uniformity than RFLP or VNTR markers which means that there is a greater probability that such a marker will be found in close proximity to a genetic locus of interest. Single nucleotide polymorphisms are less variable than VNTR markers but are mutationally more stable.

Also, the different forms of a characterized single nucleotide polymorphism, such as the biallelic markers of the present invention, are often easier to distinguish and can therefore be typed easily on a routine basis. Biallelic markers have single nucleotide based alleles and they have only two common alleles, which allows highly parallel detection and automated scoring. The biallelic markers of the present invention offer the possibility of rapid, high-throughput genotyping of a large number of individuals.

Biallelic markers are densely spaced in the genome, sufficiently informative and can be assayed in large numbers. The combined effects of these advantages make biallelic markers extremely valuable in genetic studies. Biallelic markers can be used in linkage studies in families, in allele sharing methods, in linkage disequilibrium studies in populations, in association studies of case-control populations. An important aspect of the present invention is that biallelic markers allow association studies to be performed to identify genes involved in complex traits. Association studies examine the frequency of marker alleles in unrelated case- and control-populations and are generally employed in the detection of polygenic or sporadic traits. Association studies may be conducted within the general population and are not limited to studies performed on related individuals in affected families (linkage studies). Biallelic markers in different genes can be screened in parallel for direct association with disease or response to a treatment. This multiple gene approach is a powerful tool for a variety of human genetic studies as it provides the necessary statistical power to examine the synergistic effect of multiple genetic factors on a particular phenotype, drug response, sporadic trait, or disease state with a complex genetic etiology.

Polymorphisms, Biallelic Markers and Polynucleotides Comprising Them

Polynucleotides of the Present Invention

In one aspect, the invention concerns biallelic markers associated with schizophrenia. The invention comprises chromosome 13q31-q33-related biallelic markers, region D-related biallelic markers, sbg1-related biallelic markers, g34665-related biallelic markers, sbg2-related biallelic markers, g35017-related biallelic markers and g35018-related biallelic markers. The markers and polymorphisms are generally referred to herein as A1, A2, A3 and so on. The polymorphisms and biallelic markers of the invention comprise the biallelic markers designated A1 to A360 in Table 6b. The polymorphisms of the invention also comprise the polymorphisms designated A361 to A489 in Table 6c. Also included are biallelic markers in linkage disequilibrium with the biallelic markers of the invention.

Figure 2:
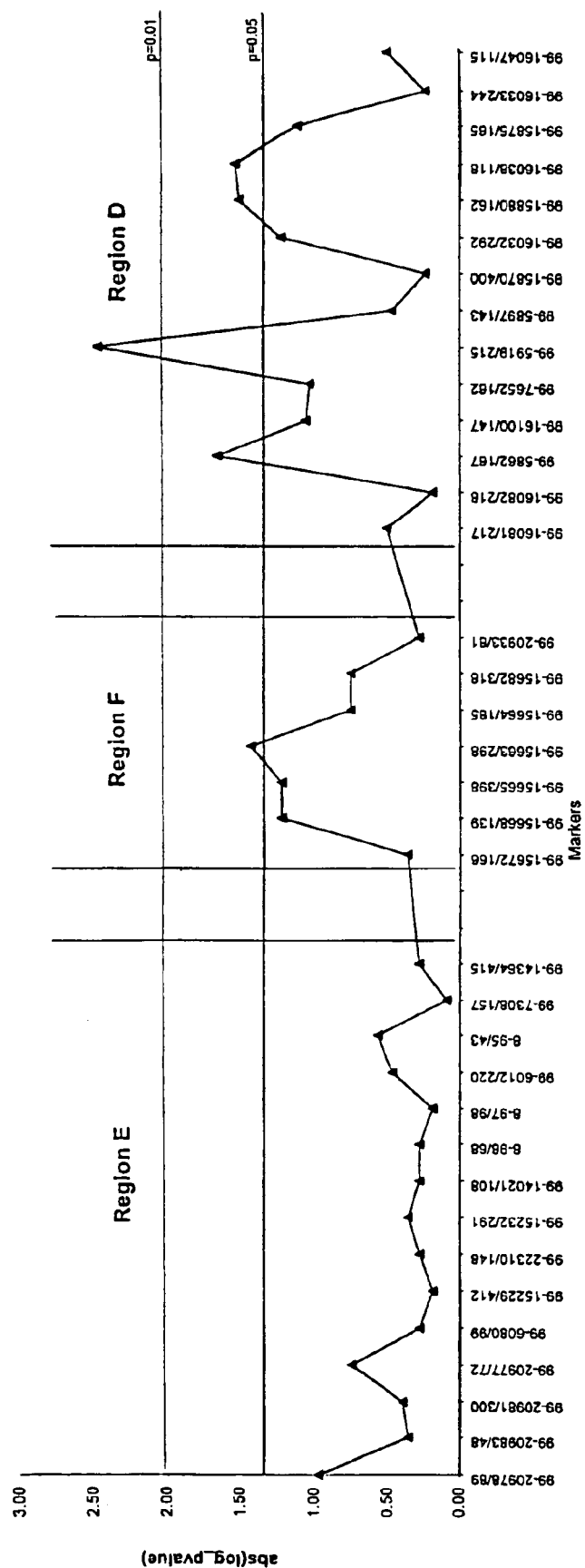
FIG. 2 is a table demonstrating the statistical significance of allelic frequencies of selected chromosome 13q31-q33 biallelic markers of the invention in sporadic and familial French Canadian schizophrenia cases and controls.

Details of chromosome 13q31-q33-related biallelic markers on the subregions designated Region D including subregions thereof designated Regions D1, D2, D3 and D4, and adjacent regions referred to as Region E and Region G are shown below and in Tables 6B and 6c. Regions D, G and E of the chromosome 13q31-q33 locus are also shown in FIG. 2. References to the corresponding SEQ ID number, to alternative marker designations, and positions of the sequence features within the SEQ ID are given in Tables 6b and 6c for biallelic markers A1 to A242 and 361 to 489 located in Region D3 and D4. Further biallelic markers from the group designated A243 to A360 in Tables 6b and 6c are located in Regions D1, D2, G and E. The relative positions of biallelic markers on Region G and E are further detailed below in Table 5g; the relative positions of biallelic markers on Region D1 and D2 are further detailed below in Table 5h.

TABLE 5g

| Biallelic marker | Region E biallelic markers | Position on contig | Biallelic marker | Region G biallelic markers | Position on contig |
|---|---|---|---|---|---|
| A311 | 99-26171-71 | 20778 | A359 | 99-27912-272 | 153458 |
| A333 | 99-26173-470 | 22456 | A322 | 99-26234-336 | 210058 |
| A308 | 99-26166-257 | 24731 | A267 | 99-15672-166 | 266449 |

TABLE 5g-continued

| Biallelic marker | Region E biallelic markers | Position on contig | Biallelic marker | Region G biallelic markers | Position on contig |
|---|---|---|---|---|---|
| A310 | 99-26169-211 | 31620 | A283 | 99-25917-115 | 268222 |
| A312 | 99-26183-156 | 35869 | A266 | 99-15668-139 | 278427 |
| A309 | 99-26167-278 | 43220 | A282 | 99-25906-131 | 291272 |
| A78 | 99-20978-89 | 51405 | A265 | 99-15665-398 | 306920 |
| A275 | 99-20983-48 | 65076 | A264 | 99-15664-185 | 311251 |
| A272 | 99-20977-72 | 70519 | A268 | 99-15682-318 | 315770 |
| A274 | 99-20981-300 | 94914 | A271 | 99-20933-81 | 342868 |
| A327 | 99-6080-99 | 134366 | A323 | 99-26238-186 | 347179 |
| A325 | 99-5912-49 | 149345 | A302 | 99-26146-264 | 349864 |
| A252 | 99-15229-412 | 154582 | A321 | 99-26233-275 | 362053 |
| A276 | 99-22310-148 | 161605 | A279 | 99-25869-182 | 362236 |
| A254 | 99-15232-291 | 162153 | A317 | 99-26222-149 | 391049 |
| A247 | 99-14021-108 | 164660 | A301 | 99-26138-193 | 400078 |
| A300 | 99-26126-498 | 170445 | A318 | 99-26223-225 | 405361 |
| A329 | 99-7337-204 | 198083 | A319 | 99-26225-148 | 416529 |
| A243 | 8-94-252 | 206618 | A284 | 99-25924-215 | 421281 |
| A253 | 99-15231-219 | 212050 | A320 | 99-26228-172 | 427201 |
| A246 | 8-98-68 | 213871 | A280 | 99-25881-275 | 435974 |
| A245 | 8-97-98 | 215017 | A281 | 99-25897-264 | 440452 |
| A326 | 99-6012-220 | 216597 | A337 | 99-26769-256 | 471739 |
| A255 | 99-15239-377 | 223699 | A338 | 99-26772-268 | 483511 |
| A244 | 8-95-43 | 236882 | A339 | 99-26776-209 | 494003 |
| A328 | 99-7308-157 | 239008 | A340 | 99-26779-437 | 505947 |
| A248 | 99-14364-415 | 255729 | A341 | 99-26781-25 | 514635 |
| | | | A342 | 99-26782-300 | 516212 |
| | | | A343 | 99-26783-81 | 519187 |
| | | | A344 | 99-26787-96 | 529412 |
| | | | A345 | 99-26789-201 | 540145 |
| | | | A316 | 99-26201-267 | 584018 |
| | | | A315 | 99-26191-58 | 601044 |
| | | | A314 | 99-26190-20 | 602591 |
| | | | A313 | 99-26189-164 | 603145 |
| | | | A277 | 99-25029-241 | 727473 |
| | | | A336 | 99-26559-315 | 740802 |

TABLE 5h

| Biallelic marker | Region D1 biallelic markers | Position on contig | Biallelic marker | Region D2 biallelic markers | Position on contig |
|---|---|---|---|---|---|
| A357 | 99-27365/421 | 48742 | A304 | 99-26150/276 | 168065 |
| A356 | 99-27361/181 | 54932 | A307 | 99-26156/290 | 173255 |
| A257 | 99-15253/382 | 56599 | A306 | 99-26154/107 | 175557 |
| A355 | 99-27360/142 | 57371 | A305 | 99-26153/44 | 177194 |
| A251 | 99-15065/85 | 61002 | A298 | 99-25985/194 | 186447 |
| A346 | 99-27297/280 | 61855 | A292 | 99-25974/143 | 190018 |
| A262 | 99-15355/150 | 62749 | A335 | 99-26284/394 | 193065 |
| A324 | 99-5873/159 | 64700 | A303 | 99-26147/396 | 196922 |
| A261 | 99-15280/432 | 76977 | A285 | 99-25950/121 | 205288 |
| A347 | 99-27306/108 | 92355 | A294 | 99-25978/166 | 215025 |
| A249 | 99-15056/99 | 93854 | A293 | 99-25977/311 | 216394 |
| A258 | 99-15256/392 | 98336 | A291 | 99-25972/317 | 224712 |
| A349 | 99-27323/372 | 100260 | A297 | 99-25984/312 | 230966 |
| A260 | 99-15261/202 | 101114 | A287 | 99-25965/399 | 236799 |
| A250 | 99-15063/155 | 105587 | A286 | 99-25961/376 | 244955 |
| A259 | 99-15258/337 | 110395 | A288 | 99-25966/241 | 254680 |
| A348 | 99-27312/58 | 117521 | A350 | 99-27335/191 | 25486 |
| A351 | 99-27345/189 | 134904 | A289 | 99-25967/57 | 257662 |
| A352 | 99-27349/267 | 138974 | A290 | 99-25969/200 | 261166 |
| A353 | 99-27352/197 | 141065 | A296 | 99-25980/173 | 261957 |
| A354 | 99-27353/105 | 141494 | A295 | 99-25979/93 | 263848 |
| | | | A299 | 99-25989/398 | 269515 |
| | | | A334 | 99-26267/524 | 275710 |

The polynucleotide of the invention may consist of, consist essentially of, or comprise a contiguous span of nucleotides of a sequence from any of SEQ ID Nos. 1 to 26, 36 to 40 and 54 to 229 as well as sequences which are complementary thereto ("complements thereof"). The "contiguous span" may be at least 8, 10, 12, 15, 18, 20, 25, 35, 40, 50, 70, 80, 100, 250, 500, 1000 or 2000 nucleotides in length, to the extent that a contiguous span of these lengths is consistent with the lengths of the particular Sequence ID.

The present invention encompasses polynucleotides for use as primers and probes in the methods of the invention. These polynucleotides may consist of, consist essentially of, or comprise a contiguous span of nucleotides of a sequence from any of SEQ ID Nos. 1 to 26, 36 to 40 and 54 to 229 as well as sequences which are complementary thereto ("complements thereof"). The "contiguous span" may be at least 8, 10, 12, 15, 18, 20, 25, 35, 40, 50, 70, 80, 100, 250, 500, 1000 or 2000 nucleotides in length, to the extent that a contiguous span of these lengths is consistent with the lengths of the particular Sequence ID. It should be noted that the polynucleotides of the present invention are not limited to having the exact flanking sequences surrounding the polymorphic bases which, are enumerated in the Sequence Listing. Rather, it will be appreciated that the flanking sequences surrounding the biallelic markers and other polymorphisms of the invention, or any of the primers of probes of the invention which, are more distant from the markers, may be lengthened or shortened to any extent compatible with their intended use and the present invention specifically contemplates such sequences. It will be appreciated that the polynucleotides of SEQ ID Nos. 1 to 26, 36 to 40 and 54 to 229 may be of any length compatible with their intended use. Also the flanking regions outside of the contiguous span need not be homologous to native flanking sequences which actually occur in human subjects. The addition of any nucleotide sequence, which is compatible with the nucleotides intended use is specifically contemplated. The contiguous span may optionally include the biallelic markers of the invention in said sequence. Biallelic markers generally comprise a polymorphism at one single base position. Each biallelic marker therefore corresponds to two forms of a polynucleotide sequence which, when compared with one another, present a nucleotide modification at one position. Usually, the nucleotide modification involves the substitution of one nucleotide for another. Optionally allele 1 or allele 2 of the biallelic markers disclosed in Table 6b may be specified as being present at the biallelic marker of the invention. The contiguous span may optionally include a nucleotide at a polymorphism position described in Table 6c, including single nucleotide substitutions, deletions as well as multiple nucleotide deletions. The polymorphisms of Table 6c have not been validated as biallelic markers, but are expected to be mostly biallelic and may also be referred to as biallelic markers herein. Optionally, allele 1 or allele 2 of the polymorphisms of Table 6c may be specified as being present at the polymorphism of the invention. Preferred polynucleotides may consist of, consist essentially of, or comprise a contiguous span of nucleotides of a sequence from SEQ ID Nos. 1 to 26, 36 to 40 and 54 to 229 as well as sequences which are complementary thereto. The "contiguous span" may be at least 8, 10, 12, 15, 18, 20, 25, 35, 40, 50, 70, 80, 100, 250, 500, 1000 or 2000 nucleotides in length, to the extent that a contiguous span of these lengths is consistent with the lengths of the particular Sequence ID.

A preferred probe or primer comprises a nucleic acid comprising a polynucleotide selected from the group of the nucleotide sequences of P1 to P360 and the complementary sequence thereto, B1 to B229, C1 to C229, D1 to D360, E1 to E360.

The invention also relates to polynucleotides that hybridize, under conditions of high or intermediate stringency, to a polynucleotide of any of SEQ ID Nos. 1 to 26, 36 to 40 and 54 to 229 as well as sequences, which are complementary thereto. Preferably such polynucleotides are at least 20, 25, 35, 40, 50, 70, 80, 100, 250, 500, 1000 or 2000 nucleotides in length, to the extent that a polynucleotide of these lengths is consistent with the lengths of the particular Sequence ID. Preferred polynucleotides comprise a polymorphism of the invention. Optionally either allele 1 or allele 2 of the polymorphism disclosed in Table 6c may be specified as being present at the polymorphism of the invention. Particularly preferred polynucleotides comprise a biallelic marker of the invention. Optionally either allele 1 or allele 2 of the biallelic markers disclosed in Table 6b may be specified as being present at the biallelic marker of the invention. Conditions of high stringency are further described herein.

The primers of the present invention may be designed from the disclosed sequences for any method known in the art. A preferred set of primers is fashioned such that the 3' end of the contiguous span of identity with the sequences of any of SEQ ID Nos. 1 to 26, 36 to 40 and 54 to 229 is present at the 3' end of the primer. Such a configuration allows the 3' end of the primer to hybridize to a selected nucleic acid sequence and dramatically increases the efficiency of the primer for amplification or sequencing reactions. In a preferred set of primers the contiguous span is found in one of the sequences described in Table 6a. Allele specific primers may be designed such that a biallelic marker or other polymorphism of the invention is at the 3' end of the contiguous span and the contiguous span is present at the 3' end of the primer. Such allele specific primers tend to selectively prime an amplification or sequencing reaction so long as they are used with a nucleic acid sample that contains one of the two alleles present at said marker. The 3' end of primer of the invention may be located within or at least 2, 4, 6, 8, 10, 12, 15, 18, 20, 25, 50, 100, 250, 500, or 1000 nucleotides upstream of abiallelic marker of the invention in said sequence or at any other location which is appropriate for their intended use in sequencing, amplification or the location of novel sequences or markers. Primers with their 3' ends located 1 nucleotide upstream of an biallelic marker of the invention have a special utility as microsequencing assays. Preferred microsequencing primers are described in Table 6d.

The probes of the present invention may be designed from the disclosed sequences for any method known in the art, particularly methods which allow for testing if a particular sequence or marker disclosed herein is present. A preferred set of probes may be designed for use in the hybridization assays of the invention in any manner known in the art such that they selectively bind to one allele of a biallelic marker or other polymorphism, but not the other under any particular set of assay conditions. Preferred hybridization probes may consists of, consist essentially of, or comprise a contiguous span which ranges in length from 8, 10, 12, 15, 18 or 20 to 25, 35, 40, 50, 60, 70, or 80 nucleotides, or be specified as being 12, 15, 18, 20, 25, 35, 40, or 50 nucleotides in length and including an biallelic marker or other polymorphism of the invention in said sequence. In a preferred embodiment, either of allele 1 or 2 disclosed in Table 6b or 6c may be specified as being present at the biallelic marker site. In another preferred embodiment, said biallelic marker may be within 6, 5, 4, 3, 2, or 1 nucleotides of the center of the hybridization probe or at the center of said probe.

In one embodiment the invention encompasses isolated, purified, and recombinant polynucleotides comprising, consisting of, or consisting essentially of a contiguous span of 8 to 50 nucleotides of any one of SEQ ID Nos 1 to 26, 36 to 40 and 54 to 229 and the complement thereof, wherein said span includes a polymorphism of the invention, a chromosome 13q31-q33-related biallelic marker, region D-related biallelic marker, or sbg1-, g34665-, sbg2-, g35017- or g35018-related biallelic marker in said sequence; optionally, wherein said polymorphism, chromosome 13q31-q33-related biallelic marker, region D-related biallelic marker, or sbg1-, g34665-, sbg2-, g35017- or g35018-related biallelic marker selected from the group consisting of A1 to A489, and the complements thereof, or optionally the biallelic markers in linkage disequilibrium therewith; optionally, wherein said chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A246, A250, A251, A253, A255, A259, A266, A268 to A232, A328 to A360 and 361 to 489; optionally, wherein said chromosome 13q31-q33-related biallelic marker, region D-related biallelic marker, sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A242 and 361 to 489, and the complements thereof, or optionally the biallelic markers in linkage disequilibrium therewith; optionally, wherein said chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A242, A250 to A251, A259, A269 to A270, A278, A285 to A299, A303 to A307, A330, A334 to A335 and A346 to 357 and 361 to 489, and the complements thereof, or optionally the biallelic markers in linkage disequilibrium therewith; optionally, wherein said contiguous span is 18 to 35 nucleotides in length and said biallelic marker is within 4 nucleotides of the center of said polynucleotide; optionally, wherein said polynucleotide consists of said contiguous span and said contiguous span is 25 nucleotides in length and said biallelic marker is at the center of said polynucleotide; optionally, wherein the 3' end of said contiguous span is present at the 3' end of said polynucleotide; and optionally, wherein the 3' end of said contiguous span is located at the 3' end of said polynucleotide and said biallelic marker is present at the 3' end of said polynucleotide. In a preferred embodiment, said probes comprise, consists of, or consists essentially of a sequence selected from the following sequences: P1 to P360 and the complementary sequences thereto.

In another embodiment the invention encompasses isolated, purified and recombinant polynucleotides comprising, consisting of, or consisting essentially of a contiguous span of 8 to 50 nucleotides of any one of SEQ ID Nos 1 to 26, 36 to 40 and 54 to 229, or the complement thereof, wherein the 3' end of said contiguous span is located at the 3' end of said polynucleotide, and wherein the 3' end of said polynucleotide is located within 20 nucleotides upstream of a polymorphism of the invention, chromosome 13q31-q33-related biallelic marker, region D-related biallelic marker, or sbg1-, g34665-, sbg2-, g35017- or g35018-related biallelic marker in said sequence; optionally, wherein said chromosome 13q31-q33-related biallelic marker, region D-related biallelic marker, or sbg1-, g34665-, sbg2-, g35017- or g35018-related biallelic marker is selected from the group consisting of A1 to A489, and the complements thereof, or optionally the biallelic markers in linkage disequilibrium therewith; optionally, wherein said a chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A246, A250, A251, A253, A255, A259, A266, A268 to A232, A328 to A360, and 361 to 489, and the complements thereof, or optionally the biallelic markers in linkage disequilibrium therewith; optionally, wherein said chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A242 and 361 to 489; optionally, wherein said chromosome 13q31-q33-related biallelic marker, region D-related biallelic marker, or sbg1-, g34665-, sbg2-, g35017- or g35018-related biallelic marker is selected from the group consisting of optionally, wherein said chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A242, A250 to A251, A259, A269 to A270, A278, A285 to A299, A303 to A307, A330, A334 to A335, A346 to 357 and 361 to 489, and the complements thereof, or optionally the biallelic markers in linkage disequilibrium therewith; optionally, wherein the 3' end of said polynucleotide is located 1 nucleotide upstream of said chromosome 13q31-q33-related biallelic marker, region D-related biallelic marker, or sbg1-, g34665-, sbg2-, g35017- or g35018-related biallelic marker; and optionally, wherein said polynucleotide comprises, consists of, or consists essentially of a sequence selected from the following sequences: D1 to D360 and E1 to E360.

In a further embodiment, the invention encompasses isolated, purified, or recombinant polynucleotides comprising, consisting of, or consisting essentially of a sequence selected from the following sequences: B1 to B229 and C1 to C229.

In an additional embodiment, the invention encompasses polynucleotides for use in hybridization assays, sequencing assays, and enzyme-based mismatch detection assays for determining the identity of the nucleotide at a chromosome 13q31-q33-related biallelic marker, region D-related biallelic marker, or sbg1-, g34665-, sbg2-, g35017- or g35018-related biallelic marker in any of SEQ ID Nos. 1 to 26, 36 to 40 and 54 to 229 or the complement thereof, as well as polynucleotides for use in amplifying segments of nucleotides comprising a polymophism of the invention, a chromosome 13q31-q33-related biallelic marker, region D-related biallelic marker, or sbg1-, g34665-, sbg2-, g35017- or g35018-related biallelic marker in any of SEQ ID Nos 1 to 26, 36 to 40 and 54 to 229 or the complement thereof; optionally, wherein said chromosome 13q31-q33-related biallelic marker, region D-related biallelic marker, or sbg1-, g34665-, sbg2-, g35017- or g35018-related biallelic marker is selected from the group consisting of A1 to A489, and the complements thereof, or optionally the biallelic markers in linkage disequilibrium therewith; optionally, wherein said chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A246, A250, A251, A253, A255, A259, A266, A268 to A232, A328 to A360 and 361 to 489, and the complements thereof, or optionally the biallelic markers in linkage disequilibrium therewith; optionally, wherein chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A242, A250 to A251, A259, A269 to A270, A278, A285 to A299, A303 to A307, A330, A334 to A335 and A346 to 357 and 361 to 489, and the complements thereof, or optionally the biallelic markers in linkage disequilibrium therewith; and optionally, wherein chromosome 13q31-q33-related biallelic marker, region D-related biallelic marker, or sbg1-, g34665-, sbg2-, g35017- or g35018-related biallelic marker is selected from the group consisting of A1 to A69, A71 to A74, A76 to A94, A96 to A106, A108 to A112, A114 to A177, A179 to A197, A199 to A222, A224 to A242 and 361 to 489, and the complements thereof, or optionally the biallelic markers in linkage disequilibrium therewith.

These arrays may generally be produced using mechanical synthesis methods or light directed synthesis methods, which incorporate a combination of photolithographic methods and solid phase oligonucleotide synthesis (Fodor et al., Science, 251:767–777, 1991, incorporated herein by reference). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854 and 5,412,087 and in PCT Publications WO 90/15070, WO 92/10092 and WO 95/11995, each incorporated herein by reference, which describe methods for forming oligonucleotide arrays through techniques such as light-directed synthesis technique. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256, each incorporated herein by reference.

Oligonucleotide arrays may comprise at least one of the sequences selected from the group consisting of SEQ ID Nos. 1 to 26, 36 to 40 and 54 to 229; and the sequences complementary thereto or a fragment thereof of at least 8, 10, 12, 15, 18, 20, 25, 35, 40, 50, 70, 80, 100, 250, 500, 1000 or 2000 consecutive nucleotides, to the extent that fragments of these lengths is consistent with the lengths of the particular Sequence ID, for determining whether a sample contains one or more alleles of the biallelic markers of the present invention. Oligonucleotide arrays may also comprise at least one of the sequences selected from the group consisting of SEQ ID Nos. 1 to 26, 36 to 40 and 54 to 229; and the sequences complementary thereto or a fragment thereof of at least 8, 10, 12, 15, 18, 20, 25, 35, 40, 50, 70, 80, 100, 250, 500, 1000 or 2000 consecutive nucleotides, to the extent that fragments of these lengths is consistent with the lengths of the particular Sequence ID, for amplifying one or more alleles of the biallelic markers of Table 6b or polymorphisms of Table 6c. In other embodiments, arrays may also comprise at least one of the sequences selected from the group consisting of SEQ ID Nos. 1 to 26, 36 to 40 and 54 to 229; and the sequences complementary thereto or a fragment thereof of at least 8, 10, 12, 15, 18, 20, 25, 35, 40, 50, 70, 80, 100, 250, 500, 1000 or 2000 consecutive nucleotides, to the extent that fragments of these lengths is consistent with the lengths of the particular Sequence ID, for conducting microsequencing analyses to determine whether a sample contains one or more alleles of the biallelic markers of the invention. In still further embodiments, the oligonucleotide array may comprise at least one of the sequences selecting from the group consisting of SEQ ID Nos. 1 to 26, 36 to 40 and 54 to 229; and the sequences complementary thereto or a fragment thereof at least 8, 10, 12, 15, 18, 20, 25, 35, 40, 50, 70, 80, 100, 250, 500, 1000 or 2000 nucleotides in length, to the extent that fragments of these lengths is consistent with the lengths of the particular Sequence ID, for determining whether a sample contains one or more alleles of the polymorphisms and biallelic markers of the present invention.

A further object of the invention relates to an array of nucleic acid sequences comprising either at least one of the sequences selected from the group consisting of P1 to P360, B1 to B229, C1 to C229, D1 to D360 E1 to E360 or the sequences complementary thereto or a fragment thereof of at least 8, 10, 12, 15, 18, 20, 25, 30, or 40 consecutive nucleotides thereof, or at least one sequence comprising at least 1, 2, 3, 4, 5, 10, 20 biallelic markers selected from the group consisting of A1 to A489 or the complements thereof. The invention also pertains to an array of nucleic acid sequences comprising either at least 1, 2, 3, 4, 5, 10, 20 of the sequences selected from the group consisting of P1 to P360, B1 to B229, C1 to C229, D1 to D360, E1 to E360 or the sequences complementary thereto or a fragment thereof of at least 8 consecutive nucleotides thereof, or at least two sequences comprising a biallelic marker selected from the group consisting of A1 to A360 or the complements thereto.

The present invention also encompasses diagnostic kits comprising one or more polynucleotides of the invention, optionally with a portion or all of the necessary reagents and instructions for genotyping a test subject by determining the identity of a nucleotide at an biallelic marker of the invention. The polynucleotides of a kit may optionally be attached to a solid support, or be part of an array or addressable array of polynucleotides. The kit may provide for the determination of the identity of the nucleotide at a marker position by any method known in the art including, but not limited to, a sequencing assay method, a microsequencing assay method, a hybridization assay method, or enzyme-based mismatch detection assay. Optionally such a kit may include instructions for scoring the results of the determination with respect to the test subjects' predisposition to schizophrenia, or likely response to an agent acting on schizophrenia, or chances of suffering from side effects to an agent acting on schizophrenia.

Finally, in any embodiments of the present invention, a biallelic marker may optionally comprise:

(a) a biallelic marker selected from the group consisting of sbg1-related markers A85 to A219, or more preferably a biallelic marker selected from the group consisting of sbg1-related markers A85 to A94, A96 to A106, A108 to A112, A114 to A177, A179 to A197 and A199 to A219;

(b) a biallelic marker selected from the group consisting of g34665-related markers A230 to A236;

(c) a biallelic marker selected from the group consisting of sbg2-related markers A79 to A99;

(d) the g35017-related marker A41;

(e) a biallelic marker selected from the group consisting of g35018-related markers A1 to A39;

(f) a biallelic marker selected from the group consisting of A239, A227, A198, A228, A223, A107, A218, A270, A75, A62, A65 and A70;

(g) a biallelic marker selected from the group consisting of A48, A60, A61, A62, A65, A70, A75, A76, A80, A107, A108, A198, A218, A221, A223, A227, A228, A239, A285, A286, A287, A288, A290, A292, A293, A295, A299 and A304;

(h) a biallelic marker selected from the group consisting of A304, A307, A305, A298, A292, A293, A291, A287, A286, A288, A289, A290, 99-A295 A299, A241, A239, A228, A227, A223, A221, A218, A198, A178, 99-24649/186 A108, A107, A80, A75, A70, A65, and A62; and/or (i) a biallelic marker selected from the group consisting of A304, A307, A305, A298, A292, A293, A291, A287, A286, A288, A289, A290, A295, A299, A241, A239, A228, A227, A223, A221, A218, A198, A178, A108, A107, A80, A76, A75, A70, A65, A62, A61, A60, A48.

Optionally, in any of the embodiments described herein, a Region D- or chromosome 13q31-q33-related biallelic marker may be selected from the group consisting of A1 to A69, A71 to A74, A76 to A94, A96 to A106, A108 to A112, A114 to A177, A179 to A197, A199 to A222, A224 to A242, A250 to A251, A259, A269 to A270, A278, A285 to A299, A303 to A307, A330, A334 to A335, A346 to 357 and 361 to 489. Optionally, in any of the embodiments described herein, a chromosome 13q31-q33-related biallelic marker may be selected from the group consisting of A1 to A69, A71 to A74, A76 to A94, A96 to A106, A108 to A112, A114 to A177, A179 to A197, A199 to A222, A224 to A246, A250, A251, A253, A255, A259, A266, A268 to A232 and A328 to A360. A set of said Region D-related biallelic markers or chromosome 13q31-q33-related biallelic markers may comprise at least 1, 2, 3, 4, 5, 10, 20, 40, 50, 100 or 200 of said biallelic markers, respectively.

Optionally, any of the compositions of methods described herein may specifically exclude at least 1, 2, 3, 4, 5, 10, 20 biallelic markers, or all of the biallelic markers selected from the group consisting of: A70, A75, A95, A107, A113, A178, A198, A223, A247 to A249, A252, A254, A256 to A258, A260 to A265, A267, A324 to A328.

Furthermore, in any of the embodiments of the present invention, a set of chromosome 13q31-q33-related biallelic markers, Region D-related biallelic markers, or sbg1-, g34665-, sbg2-, g35017- or g35018-related biallelic markers may comprise at least 1, 2, 3, 4, 5, 10, 20, 40, 50, 100 or 200 of said biallelic markers.

Methods for De Novo Identification of Biallelic Markers

Any of a variety of methods can be used to screen a genomic fragment for single nucleotide polymorphisms such as differential hybridization with oligonucleotide probes, detection of changes in the mobility measured by gel electrophoresis or direct sequencing of the amplified nucleic acid. A preferred method for identifying biallelic markers involves comparative sequencing of genomic DNA fragments from an appropriate number of unrelated individuals.

In a first embodiment, DNA samples from unrelated individuals are pooled together, following which the genomic DNA of interest is amplified and sequenced. The nucleotide sequences thus obtained are then analyzed to identify significant polymorphisms. One of the major advantages of this method resides in the fact that the pooling of the DNA samples substantially reduces the number of DNA amplification reactions and sequencing reactions, which must be carried out. Moreover, this method is sufficiently sensitive so that a biallelic marker obtained thereby usually demonstrates a sufficient frequency of its less common allele to be useful in conducting association studies. Usually, the frequency of the least common allele of a biallelic marker identified by this method is at least 10%.

In a second embodiment, the DNA samples are not pooled and are therefore amplified and sequenced individually. This method is usually preferred when biallelic markers need to be identified in order to perform association studies within candidate genes. Preferably, highly relevant gene regions such as promoter regions or exon regions may be screened for biallelic markers. A biallelic marker obtained using this method may show a lower degree of informativeness for conducting association studies, e.g. if the frequency of its less frequent allele may be less than about 10%. Such a biallelic marker will however be sufficiently informative to conduct association studies and it will further be appreciated that including less informative biallelic markers in the genetic analysis studies of the present invention, may allow in some cases the direct identification of causal mutations, which may, depending on their penetrance, be rare mutations.

The following is a description of the various parameters of a preferred method used by the inventors for the identification of the biallelic markers of the present invention.

Genomic DNA Samples

The genomic DNA samples from which the biallelic markers of the present invention are generated are preferably obtained from unrelated individuals corresponding to a heterogeneous population of known ethnic background. The number of individuals from whom DNA samples are obtained can vary substantially, preferably from about 10 to about 1000, more preferably from about 50 to about 200 individuals. Usually, DNA samples are collected from at least about 100 individuals in order to have sufficient polymorphic diversity in a given population to identify as many markers as possible and to generate statistically significant results.

As for the source of the genomic DNA to be subjected to analysis, any test sample can be foreseen without any particular limitation. These test samples include biological samples, which can be tested by the methods of the present invention described herein, and include human and animal body fluids such as whole blood, serum, plasma, cerebrospinal fluid, urine, lymph fluids, and various external secretions of the respiratory, intestinal and genitourinary tracts, tears, saliva, milk, white blood cells, myelomas and the like; biological fluids such as cell culture supernatants; fixed tissue specimens including tumor and non-tumor tissue and lymph node tissues; bone marrow aspirates and fixed cell specimens. The preferred source of genomic DNA used in the present invention is from peripheral venous blood of each donor. Techniques to prepare genomic DNA from biological samples are well known to the skilled technician. Details of a preferred embodiment are provided in Example 1. The person skilled in the art can choose to amplify pooled or unpooled DNA samples.

DNA Amplification

The identification of biallelic markers in a sample of genomic DNA may be facilitated through the use of DNA amplification methods. DNA samples can be pooled or unpooled for the amplification step. DNA amplification techniques are well known to those skilled in the art. Various methods to amplify DNA fragments carrying biallelic markers are further described hereinafter herein. The PCR technology is the preferred amplification technique used to identify new biallelic markers.

In a first embodiment, biallelic markers are identified using genomic sequence information generated by the inventors. Genomic DNA fragments, such as the inserts of the BAC clones described above, are sequenced and used to design primers for the amplification of 500 bp fragments. These 500 bp fragments are amplified from genomic DNA and are scanned for biallelic markers. Primers may be designed using the OSP software (Hillier L. and Green P., 1991). All primers may contain, upstream of the specific target bases, a common oligonucleotide tail that serves as a sequencing primer. Those skilled in the art are familiar with primer extensions, which can be used for these purposes.

In another embodiment of the invention, genomic sequences of candidate genes are available in public databases allowing direct screening for biallelic markers. Preferred primers, useful for the amplification of genomic sequences encoding the candidate genes, focus on promoters, exons and splice sites of the genes. A biallelic marker present in these functional regions of the gene have a higher probability to be a causal mutation.

Sequencing of Amplified Genomic DNA and Identification of Single Nucleotide Polymorphisms The amplification products generated as described above, are then sequenced using any method known and available to the skilled technician. Methods for sequencing DNA using either the dideoxy-mediated method (Sanger method) or the Maxam-Gilbert method are widely known to those of ordinary skill in the art. Such methods are for example disclosed in Maniatis et al. (Molecular Cloning, A Laboratory Manual, Cold Spring Harbor Press, Second Edition, 1989). Alternative approaches include hybridization to high-density DNA probe arrays as described in Chee et al. (Science 274, 610, 1996, incorporated herein by reference).

Preferably, the amplified DNA is subjected to automated dideoxy terminator sequencing reactions using a dye-primer cycle sequencing protocol. The products of the sequencing reactions are run on sequencing gels and the sequences are determined using gel image analysis. The polymorphism search is based on the presence of superimposed peaks in the electrophoresis pattern resulting from different bases occurring at the same position. Because each dideoxy terminator is labeled with a different fluorescent molecule, the two peaks corresponding to a biallelic site present distinct colors corresponding to two different nucleotides at the same position on the sequence. However, the presence of two peaks can be an artifact due to background noise. To exclude such an artifact, the two DNA strands are sequenced and a comparison between the peaks is carried out. In order to be registered as a polymorphic sequence, the polymorphism has to be detected on both strands.

The above procedure permits those amplification products, which contain biallelic markers to be identified. The detection limit for the frequency of biallelic polymorphisms detected by sequencing pools of 100 individuals is approximately 0.1 for the minor allele, as verified by sequencing pools of known allelic frequencies. However, more than 90% of the biallelic polymorphisms detected by the pooling method have a frequency for the minor allele higher than 0.25. Therefore, the biallelic markers selected by this method have a frequency of at least 0.1 for the minor allele and less than 0.9 for the major allele. Preferably at least 0.2 for the minor allele and less than 0.8 for the major allele, more preferably at least 0.3 for the minor allele and less than 0.7 for the major allele, thus a heterozygosity rate higher than 0.18, preferably higher than 0.32, more preferably higher than 0.42.

In another embodiment, biallelic markers are detected by sequencing individual DNA samples, the frequency of the minor allele of such a biallelic marker may be less than 0.1.

Validation of the Biallelic Markers of the Present Invention

The polymorphisms are evaluated for their usefulness as genetic markers by validating that both alleles are present in a population. Validation of the biallelic markers is accomplished by genotyping a group of individuals by a method of the invention and demonstrating that both alleles are present. Microsequencing is a preferred method of genotyping alleles. The validation by genotyping step may be performed on individual samples derived from each individual in the group or by genotyping a pooled sample derived from more than one individual. The group can be as small as one individual if that individual is heterozygous for the allele in question. Preferably the group contains at least three individuals, more preferably the group contains five or six individuals, so that a single validation test will be more likely to result in the validation of more of the biallelic markers that are being tested. It should be noted, however, that when the validation test is performed on a small group it may result in a false negative result if as a result of sampling error none of the individuals tested carries one of the two alleles. Thus, the validation process is less useful in demonstrating that a particular initial result is an artifact, than it is at demonstrating that there is a bona fide biallelic marker at a particular position in a sequence. All of the genotyping, haplotyping, association, and interaction study methods of the invention may optionally be performed solely with validated biallelic markers.

Evaluation of the Frequency of the Biallelic Markers of the Present Invention

The validated biallelic markers are further evaluated for their usefulness as genetic markers by determining the frequency of the least common allele at the biallelic marker site. The determination of the least common allele is accomplished by genotyping a group of individuals by a method of the invention and demonstrating that both alleles are present. This determination of frequency by genotyping step may be performed on individual samples derived from each individual in the group or by genotyping a pooled sample derived from more than one individual. The group must be large enough to be representative of the population as a whole. Preferably the group contains at least 20 individuals, more preferably the group contains at least 50 individuals, most preferably the group contains at least 100 individuals. Of course the larger the group the greater the accuracy of the frequency determination because of reduced sampling error. A biallelic marker wherein the frequency of the less common allele is 30% or more is termed a "high quality biallelic marker." All of the genotyping, haplotyping, association, and interaction study methods of the invention may optionally be performed solely with high quality biallelic markers.

Another embodiment of the invention comprises methods of estimating the frequency of an allele in a population comprising genotyping individuals from said population for a 13q31-q33-related biallelic marker and determining the proportional representation of said biallelic marker in said population. In addition, the methods of estimating the frequency of an allele in a population encompass methods with any further limitation described in this disclosure, or those following, specified alone or in any combination: Optionally, said 13q31-q33-related biallelic marker may be in a sequence selected individually or in any combination from the group consisting of SEQ Nos 1 to 26, 36 to 40 and 54 to 229; and the complements thereof; optionally, said 13q31-q33-related biallelic marker may be selected from the biallelic markers described in Table 6b or 6c; optionally, determining the frequency of a biallelic marker allele in a population may be accomplished by determining the identity of the nucleotides for both copies of said biallelic marker present in the genome of each individual in said population and calculating the proportional representation of said nucleotide at said 13q31-q33-related biallelic marker for the population; optionally, determining the frequency of a biallelic marker allele in a population may be accomplished by performing a genotyping method on a pooled biological sample derived from a representative number of individuals, or each individual, in said population, and calculating the proportional amount of said nucleotide compared with the total.

Methods of Genotyping an Individual for Biallelic Markers

Methods are provided to genotype a biological sample for one or more biallelic markers of the present invention, all of which may be performed in vitro. Such methods of genotyping comprise determining the identity of a nucleotide at an biallelic marker of the invention by any method known in the art. These methods find use in genotyping case-control populations in association studies as well as individuals in the context of detection of alleles of biallelic markers which, are known to be associated with a given trait, in which case both copies of the biallelic marker present in individual's genome are determined so that an individual may be classified as homozygous or heterozygous for a particular allele.

These genotyping methods can be performed nucleic acid samples derived from a single individual or pooled DNA samples.

Genotyping can be performed using similar methods as those described above for the identification of the biallelic markers, or using other genotyping methods such as those further described below. In preferred embodiments, the comparison of sequences of amplified genomic fragments from different individuals is used to identify new biallelic markers whereas microsequencing is used for genotyping known biallelic markers in diagnostic and association study applications.

Another embodiment of the invention encompasses methods of genotyping a biological sample comprising determining the identity of a nucleotide at a 13q31-q33-related biallelic marker. In addition, the genotyping methods of the invention encompass methods with any further limitation described in this disclosure, or those following, specified alone or in any combination: Optionally, said 13q31-q33-related biallelic marker may be in a sequence selected individually or in any combination from the group consisting of SEQ ID Nos 1 to 26, 36 to 40 and 54 to 229, and the complements thereof; optionally, said 13q31-q33-related biallelic marker may be selected individually or in any combination from the biallelic markers described in Table 6b and 6c; optionally, said method further comprises determining the identity of a second nucleotide at said biallelic marker, wherein said first nucleotide and second nucleotide are not base paired (by Watson & Crick base pairing) to one another; optionally, said biological sample is derived from a single individual or subject; optionally, said method is performed in vitro; optionally, said biallelic marker is determined for both copies of said biallelic marker present in said individual's genome; optionally, said biological sample is derived from multiple subjects or individuals; optionally, said method further comprises amplifying a portion of said sequence comprising the biallelic marker prior to said determining step; optionally, wherein said amplifying is performed by PCR, LCR, or replication of a recombinant vector comprising an origin of replication and said portion in a host cell; optionally, wherein said determining is performed by a hybridization assay, sequencing assay, microsequencing assay, or an enzyme-based mismatch detection assay.

Source of DNA for Genotyping

Any source of nucleic acids, in purified or non-purified form, can be utilized as the starting nucleic acid, provided it contains or is suspected of containing the specific nucleic acid sequence desired. DNA or RNA may be extracted from cells, tissues, body fluids and the like as described herein. While nucleic acids for use in the genotyping methods of the invention can be derived from any mammalian source, the test subjects and individuals from which nucleic acid samples are taken are generally understood to be human.

Amplification of DNA Fragments Comprising Biallelic Markers

Methods and polynucleotides are provided to amplify a segment of nucleotides comprising one or more biallelic marker of the present invention. It will be appreciated that amplification of DNA fragments comprising biallelic markers may be used in various methods and for various purposes and is not restricted to genotyping. Nevertheless, many genotyping methods, although not all, require the previous amplification of the DNA region carrying the biallelic marker of interest. Such methods specifically increase the concentration or total number of sequences that span the biallelic marker or include that site and sequences located either distal or proximal to it. Diagnostic assays may also rely on amplification of DNA segments carrying a biallelic marker of the present invention.

Amplification of DNA may be achieved by any method known in the art. The established PCR (polymerase chain reaction) method or by developments thereof or alternatives. Amplification methods which can be utilized herein include but are not limited to Ligase Chain Reaction (LCR) as described in EP A 320 308 and EP A 439 182, Gap LCR (Wolcott, M. J.), the so-called "NASBA" or "3SR" technique described in Guatelli J. C. et al. (1990) and in Compton J. (1991), Q-beta amplification as described in EPA 4544 610, strand displacement amplification as described in Walker et al. (1996) and EP A 684 315 and, target mediated amplification as described in PCT Publication WO 9322461. The disclosures of all of these publications are incorporated herein by reference LCR and Gap LCR are exponential amplification techniques, both depend on DNA ligase to join adjacent primers annealed to a DNA molecule. In Ligase Chain Reaction (LCR), probe pairs are used which include two primary (first and second) and two secondary (third and fourth) probes, all of which are employed in molar excess to target. The first probe hybridizes to a first segment of the target strand and the second probe hybridizes to a second segment of the target strand, the first and second segments being contiguous so that the primary probes abut one another in 5' phosphate-3'hydroxyl relationship, and so that a ligase can covalently fuse or ligate the two probes into a fused product. In addition, a third (secondary) probe can hybridize to a portion of the first probe and a fourth (secondary) probe can hybridize to a portion of the second probe in a similar abutting fashion. Of course, if the target is initially double stranded, the secondary probes also will hybridize to the target complement in the first instance. Once the ligated strand of primary probes is separated from the target strand, it will hybridize with the third and fourth probes which can be ligated to form a complementary, secondary ligated product. It is important to realize that the ligated products are functionally equivalent to either the target or its complement. By repeated cycles of hybridization and ligation, amplification of the target sequence is achieved. A method for multiplex LCR has also been described (WO 9320227, incorporated herein by reference).

Gap LCR (GLCR) is a version of LCR where the probes are not adjacent but are separated by 2 to 3 bases.

For amplification of mRNAs, it is within the scope of the present invention to reverse transcribe mRNA into cDNA followed by polymerase chain reaction (RT-PCR); or, to use a single enzyme for both steps as described in U.S. Pat. No. 5,322,770 or, to use Asymmetric Gap LCR (RT-AGLCR) as described by Marshall R. L. et al. (1994), the disclosures of which are incorporated herein by reference. AGLCR is a modification of GLCR that allows the amplification of RNA.

Some of these amplification methods are particularly suited for the detection of single nucleotide polymorphisms and allow the simultaneous amplification of a target sequence and the identification of the polymorphic nucleotide as it is further described herein.

The PCR technology is the preferred amplification technique used in the present invention. A variety of PCR techniques are familiar to those skilled in the art. For a review of PCR technology, see Molecular Cloning to Genetic Engineering White, B. A. Ed. (1997) and the publication entitled "PCR Methods and Applications" (1991, Cold Spring Harbor Laboratory Press). In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188, the disclosures of which are incorporated herein by reference in their entireties.

Primers can be prepared by any suitable method. As for example, direct chemical synthesis by a method such as the phosphodiester method of Narang S. A. et al. (1979), the phosphodiester method of Brown E. L. et al. (1979), the diethylphosphoramidite method of Beaucage et al. (1981) and the solid support method described in EP 0 707 592.

In some embodiments the present invention provides primers for amplifying a DNA fragment containing one or more biallelic markers of the present invention. It will be appreciated that the primers listed are merely exemplary and that any other set of primers which produce amplification products containing one or more biallelic markers of the present invention.

The spacing of the primers determines the length of the segment to be amplified. In the context of the present invention amplified segments carrying biallelic markers can range in size from at least about 25 bp to 35 kbp. Amplification fragments from 25–3000 bp are typical, fragments from 50–1000 bp are preferred and fragments from 100–600 bp are highly preferred. It will be appreciated that amplification primers for the biallelic markers may be any sequence which allow the specific amplification of any DNA fragment carrying the markers. Amplification primers may be labeled or immobilized on a solid support as described in the section titled "Oligonucleotide Probes and Primers".

Methods of Genotyping DNA Samples for Biallelic Markers

Any method known in the art can be used to identify the nucleotide present at a biallelic marker site. Since the biallelic marker allele to be detected has been identified and specified in the present invention, detection will prove simple for one of ordinary skill in the art by employing any of a number of techniques. Many genotyping methods require the previous amplification of the DNA region carrying the biallelic marker of interest. While the amplification of target or signal is often preferred at present, ultrasensitive detection methods which do not require amplification are also encompassed by the present genotyping methods. Methods well-known to those skilled in the art that can be used to detect biallelic polymorphisms include methods such as, conventional dot blot analyzes, single strand conformational polymorphism analysis (SSCP) described by Orita et al. (1989), denaturing gradient gel electrophoresis (DGGE), heteroduplex analysis, mismatch cleavage detection, and other conventional techniques as described in Sheffield, V. C. et al. (1991), White et al. (1992), Grompe, M. et al. (1989) and Grompe, M. (1993). Another method for determining the identity of the nucleotide present at a particular polymorphic site employs a specialized exonuclease-resistant nucleotide derivative as described in U.S. Pat. No. 4,656,127. The disclosures of all of the above publications are incorporated herein by reference Preferred methods involve directly determining the identity of the nucleotide present at a biallelic marker site by sequencing assay, enzyme-based mismatch detection assay, or hybridization assay. The following is a description of some preferred methods. A highly preferred method is the microsequencing technique. The term "sequencing assay" is used herein to refer to polymerase extension of duplex primer/template complexes and includes both traditional sequencing and microsequencing.

1) Sequencing Assays

The nucleotide present at a polymorphic site can be determined by sequencing methods. In a preferred embodiment, DNA samples are subjected to PCR amplification before sequencing as described above. DNA sequencing methods are described in herein. Preferably, the amplified DNA is subjected to automated dideoxy terminator sequencing reactions using a dye-primer cycle sequencing protocol. Sequence analysis allows the identification of the base present at the biallelic marker site.

2) Microsequencing Assays

In microsequencing methods, a nucleotide at the polymorphic site that is unique to one of the alleles in a target DNA is detected by a single nucleotide primer extension reaction. This method involves appropriate microsequencing primers which, hybridize just upstream of a polymorphic base of interest in the target nucleic acid. A polymerase is used to specifically extend the 3' end of the primer with one single ddNTP (chain terminator) complementary to the selected nucleotide at the polymorphic site. Next the identity of the incorporated nucleotide is determined in any suitable way.

Typically, microsequencing reactions are carried out using fluorescent ddNTPs and the extended microsequencing primers are analyzed by electrophoresis on ABI 377 sequencing machines to determine the identity of the incorporated nucleotide as described in EP 412 883. Alternatively capillary electrophoresis can be used in order to process a higher number of assays simultaneously. An example of a typical microsequencing procedure that can be used in the context of the present invention is provided in example 4.

Different approaches can be used to detect the nucleotide added to the microsequencing primer. A homogeneous phase detection method based on fluorescence resonance energy transfer has been described by Chen and Kwok (1997) and Chen et al. (1997), the disclosures of which are incorporated herein by reference. In this method amplified genomic DNA fragments containing polymorphic sites are incubated with a 5'-fluorescein-labeled primer in the presence of allelic dye-labeled dideoxyribonucleoside triphosphates and a modified Taq polymerase. The dye-labeled primer is extended one base by the dye-terminator specific for the allele present on the template. At the end of the genotyping reaction, the fluorescence intensities of the two dyes in the reaction mixture are analyzed directly without separation or purification. All these steps can be performed in the same tube and the fluorescence changes can be monitored in real time. Alternatively, the extended primer may be analyzed by MALDI-TOF Mass Spectrometry. The base at the polymorphic site is identified by the mass added onto the microsequencing primer (see Haff L. A. and Smirnov I. P., 1997, the disclosures of which are incorporated herein by reference).

Microsequencing may be achieved by the established microsequencing method or by developments or derivatives thereof. Alternative methods include several solid-phase microsequencing techniques. The basic microsequencing protocol is the same as described previously, except that the method is conducted as a heterogenous phase assay, in which the primer or the target molecule is immobilized or captured onto a solid support. To simplify the primer separation and the terminal nucleotide addition analysis, oligonucleotides are attached to solid supports or are modified in such ways that permit affinity separation as well as polymerase extension. The 5' ends and internal nucleotides of synthetic oligonucleotides can be modified in a number of different ways to permit different affinity separation approaches, e.g., biotinylation. If a single affinity group is used on the oligonucleotides, the oligonucleotides can be separated from the incorporated terminator regent. This eliminates the need of physical or size separation. More than one oligonucleotide can be separated from the terminator reagent and analyzed simultaneously if more than one affinity group is used. This permits the analysis of several nucleic acid species or more nucleic acid sequence information per extension reaction. The affinity group need not be on the priming oligonucleotide but could alternatively be present on the template. For example, immobilization can be carried out via an interaction between biotinylated DNA and streptavidin-coated microtitration wells or avidin-coated polystyrene particles. In the same manner oligonucleotides or templates may be attached to a solid support in a high-density format. In such solid phase microsequencing reactions, incorporated ddNTPs can be radiolabeled (Syvänen, 1994) or linked to fluorescein (Livak and Hainer, 1994). The detection of radiolabeled ddNTPs can be achieved through scintillation-based techniques. The detection of fluorescein-linked ddNTPs can be based on the binding of antifluorescein antibody conjugated with alkaline phosphatase, followed by incubation with a chromogenic substrate (such as p-nitrophenyl phosphate). Other possible reporter-detection pairs include: ddNTP linked to dinitrophenyl (DNP) and anti-DNP alkaline phosphatase conjugate (Harju et al., 1993) or biotinylated ddNTP and horseradish peroxidase-conjugated streptavidin with o-phenylenediamine as a substrate (WO 92/15712, the disclosures of which is incorporated herein by reference in its entirety). As yet another alternative solid-phase microsequencing procedure, Nyren et al. (1993) described a method relying on the detection of DNA polymerase activity by an enzymatic luminometric inorganic pyrophosphate detection assay (ELIDA). The disclosures of all of these publications are incorporated herein by reference Pastinen et al. (1997), incorporated herein by reference, describe a method for multiplex detection of single nucleotide polymorphism in which the solid phase minisequencing principle is applied to an oligonucleotide array format. High-density arrays of DNA probes attached to a solid support (DNA chips) are further described in herein.

In one aspect the present invention provides polynucleotides and methods to genotype one or more biallelic markers of the present invention by performing a microsequencing assay. Preferred microsequencing primers include those being featured Table 6d. It will be appreciated that the microsequencing primers listed in Table 6d are merely exemplary and that, any primer having a 3' end immediately adjacent to a polymorphic nucleotide may be used. Similarly, it will be appreciated that microsequencing analysis may be performed for any biallelic marker or any combination of biallelic markers of the present invention. One aspect of the present invention is a solid support which includes one or more microsequencing primers listed in Table 6d, or fragments comprising at least 8, at least 12, at least 15, or at least 20 consecutive nucleotides thereof and having a 3' terminus immediately upstream of the corresponding biallelic marker, for determining the identity of a nucleotide at biallelic marker site.

3) Mismatch Detection Assays Based on Polymerases and Ligases

In one aspect the present invention provides polynucleotides and methods to determine the allele of one or more biallelic markers of the present invention in a biological sample, by mismatch detection assays based on polymerases and/or ligases. These assays are based on the specificity of polymerases and ligases. Polymerization reactions places particularly stringent requirements on correct base pairing of the 3' end of the amplification primer and the joining of two oligonucleotides hybridized to a target DNA sequence is quite sensitive to mismatches close to the ligation site, especially at the 3' end. The terms "enzyme based mismatch detection assay" are used herein to refer to any method of determining the allele of a biallelic marker based on the specificity of ligases and polymerases. Preferred methods are described below. Methods, primers and various parameters to amplify DNA fragments comprising biallelic markers of the present invention are further described herein.

Allele Specific Amplification

Discrimination between the two alleles of a biallelic marker can also be achieved by allele specific amplification, a selective strategy, whereby one of the alleles is amplified without amplification of the other allele. This is accomplished by placing a polymorphic base at the 3' end of one of the amplification primers. Because the extension forms from the 3'end of the primer, a mismatch at or near this position has an inhibitory effect on amplification. Therefore, under appropriate amplification conditions, these primers only direct amplification on their complementary allele. Designing the appropriate allele-specific primer and the corresponding assay conditions are well with the ordinary skill in the art.

Ligation/Amplification Based Methods

The "Oligonucleotide Ligation Assay" (OLA) uses two oligonucleotides which are designed to be capable of hybridizing to abutting sequences of a single strand of a target molecules. One of the oligonucleotides is biotinylated, and the other is detectably labeled. If the precise complementary sequence is found in a target molecule, the oligonucleotides will hybridize such that their termini abut, and create a ligation substrate that can be captured and detected. OLA is capable of detecting biallelic markers and may be advantageously combined with PCR as described by Nickerson D. A. et al. (1990). In this method, PCR is used to achieve the exponential amplification of target DNA, which is then detected using OLA.

Other methods which are particularly suited for the detection of biallelic markers include LCR (ligase chain reaction), Gap LCR (GLCR) which are described herein. As mentioned above LCR uses two pairs of probes to exponentially amplify a specific target. The sequences of each pair of oligonucleotides, is selected to permit the pair to hybridize to abutting sequences of the same strand of the target. Such hybridization forms a substrate for a template-dependant ligase. In accordance with the present invention, LCR can be performed with oligonucleotides having the proximal and distal sequences of the same strand of a biallelic marker site. In one embodiment, either oligonucleotide will be designed to include the biallelic marker site. In such an embodiment, the reaction conditions are selected such that the oligonucleotides can be ligated together only if the target molecule either contains or lacks the specific nucleotide(s) that is complementary to the biallelic marker on the oligonucleotide. In an alternative embodiment, the oligonucleotides will not include the biallelic marker, such that when they hybridize to the target molecule, a "gap" is created as described in WO 90/01069, the disclosure of which is incorporated herein by reference in its entirety. This gap is then "filled" with complementary dNTPs (as mediated by DNA polymerase), or by an additional pair of oligonucleotides. Thus at the end of each cycle, each single strand has a complement capable of serving as a target during the next cycle and exponential allele-specific amplification of the desired sequence is obtained.

Ligase/Polymerase-mediated Genetic Bit Analysis™ is another method for determining the identity of a nucleotide at a preselected site in a nucleic acid molecule (WO 95/21271), incorporated herein by reference. This method involves the incorporation of a nucleoside triphosphate that is complementary to the nucleotide present at the preselected site onto the terminus of a primer molecule, and their subsequent ligation to a second oligonucleotide. The reaction is monitored by detecting a specific label attached to the reaction's solid phase or by detection in solution.

4) Hybridization Assay Methods

A preferred method of determining the identity of the nucleotide present at a biallelic marker site involves nucleic acid hybridization. The hybridization probes, which can be conveniently used in such reactions, preferably include the probes defined herein. Any hybridization assay may be used including Southern hybridization, Northern hybridization, dot blot hybridization and solid-phase hybridization (see Sambrook et al., Molecular Cloning—A Laboratory Manual, Second Edition, Cold Spring Harbor Press, N.Y., 1989).

Hybridization refers to the formation of a duplex structure by two single stranded nucleic acids due to complementary base pairing. Hybridization can occur between exactly complementary nucleic acid strands or between nucleic acid strands that contain minor regions of mismatch. Specific probes can be designed that hybridize to one form of a biallelic marker and not to the other and therefore are able to discriminate between different allelic forms. Allele-specific probes are often used in pairs, one member of a pair showing perfect match to a target sequence containing the original allele and the other showing a perfect match to the target sequence containing the alternative allele. Hybridization conditions should be sufficiently stringent that there is a significant difference in hybridization intensity between alleles, and preferably an essentially binary response, whereby a probe hybridizes to only one of the alleles. Stringent, sequence specific hybridization conditions, under which a probe will hybridize only to the exactly complementary target sequence are well known in the art (Sambrook et al., Molecular Cloning—A Laboratory Manual, Second Edition, Cold Spring Harbor Press, N.Y., 1989). Stringent conditions are sequence dependent and will be different in different circumstances. Generally, stringent conditions are selected to be about 5° C. lower than the thermal melting point (Tm) for the specific sequence at a defined ionic strength and pH. By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20×$10^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of high and intermediate stringency which may be used are well known in the art and as cited in Sambrook et al. (Molecular Cloning—A Laboratory Manual, Second Edition, Cold Spring Harbor Press, N.Y., 1989) and Ausubel et al. (Current Protocols in Molecular Biology, Green Publishing Associates and Wiley Interscience, N.Y., 1989).

Although such hybridizations can be performed in solution, it is preferred to employ a solid-phase hybridization assay. The target DNA comprising a biallelic marker of the present invention may be amplified prior to the hybridization reaction. The presence of a specific allele in the sample is determined by detecting the presence or the absence of stable hybrid duplexes formed between the probe and the target DNA. The detection of hybrid duplexes can be carried out by a number of methods. Various detection assay formats are well known which utilize detectable labels bound to either the target or the probe to enable detection of the hybrid duplexes. Typically, hybridization duplexes are separated from unhybridized nucleic acids and the labels bound to the duplexes are then detected. Those skilled in the art will recognize that wash steps may be employed to wash away excess target DNA or probe. Standard heterogeneous assay formats are suitable for detecting the hybrids using the labels present on the primers and probes.

Two recently developed assays allow hybridization-based allele discrimination with no need for separations or washes (see Landegren U. et al., 1998, incorporated herein by reference). The TaqMan assay takes advantage of the 5' nuclease activity of Taq DNA polymerase to digest a DNA probe annealed specifically to the accumulating amplification product. TaqMan probes are labeled with a donor-acceptor dye pair that interacts via fluorescence energy transfer. Cleavage of the TaqMan probe by the advancing polymerase during amplification dissociates the donor dye from the quenching acceptor dye, greatly increasing the donor fluorescence. All reagents necessary to detect two allelic variants can be assembled at the beginning of the reaction and the results are monitored in real time (see Livak et al, 1995, incorporated herein by reference). In an alternative homogeneous hybridization-based procedure, molecular beacons are used for allele discriminations. Molecular beacons are hairpin-shaped oligonucleotide probes that report the presence of specific nucleic acids in homogeneous solutions. When they bind to their targets they undergo a conformational reorganization that restores the fluorescence of an internally quenched fluorophore (Tyagi et al., 1998).

By assaying the hybridization to an allele specific probe, one can detect the presence or absence of a biallelic marker allele in a given sample.

High-Throughput parallel hybridizations in array format are specifically encompassed within "hybridization assays" and are described below.

Hybridization to Addressable Arrays of Oligonucleotides

Hybridization assays based on oligonucleotide arrays rely on the differences in hybridization stability of short oligonucleotides to perfectly matched and mismatched target sequence variants. Efficient access to polymorphism information is obtained through a basic structure comprising high-density arrays of oligonucleotide probes attached to a solid support (the chip) at selected positions. Each DNA chip can contain thousands to millions of individual synthetic DNA probes arranged in a grid-like pattern and miniaturized to the size of a dime.

The chip technology has already been applied with success in numerous cases. For example, the screening of mutations has been undertaken in the BRCA1 gene, in *S. cerevisiae* mutant strains, and in the protease gene of HIV-1 virus (Hacia et al., 1996; Shoemaker et al., 1996; Kozal et al., 1996, the disclosclosures of which are incorporated herein by reference). Chips of various formats for use in detecting biallelic polymorphisms can be produced on a customized basis by Affymetrix (GeneChip™), Hyseq (HyChip and HyGnostics), and Protogene Laboratories.

In general, these methods employ arrays of oligonucleotide probes that are complementary to target nucleic acid sequence segments from an individual which, target sequences include a polymorphic marker. EP785280, the disclosures of which is incorporated herein by reference in its entirety, describes a tiling strategy for the detection of single nucleotide polymorphisms. Briefly, arrays may generally be "tiled" for a large number of specific polymorphisms. By "tiling" is generally meant the synthesis of a defined set of oligonucleotide probes which is made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995, incorporated herein by reference. In a particular aspect, arrays are tiled for a number of specific, identified biallelic marker sequences. In particular the array is tiled to include a number of detection blocks, each detection block being specific for a specific biallelic marker or a set of biallelic markers. For example, a detection block may be tiled to include a number of probes, which span the sequence segment that includes a specific polymorphism. To ensure probes that are complementary to each allele, the probes are synthesized in pairs differing at the biallelic marker. In addition to the probes differing at the polymorphic base, monosubstituted probes are also generally tiled within the detection block. These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the biallelic marker. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the biallelic marker are present in the sample. Hybridization and scanning may be carried out as described in PCT application No. WO 92/10092 and WO 95/11995 and U.S. Pat. No. 5,424,186, the disclosures of which are incorporated herein by reference.

Thus, in some embodiments, the chips may comprise an array of nucleic acid sequences of fragments of about 15 nucleotides in length. In further embodiments, the chip may comprise an array including at least one of the sequences selected from the group consisting of SEQ ID Nos. 1 to 26, 36 to 40 and 54 to 229 and the sequences complementary thereto, or a fragment thereof at least about 8 consecutive nucleotides, preferably 10, 15, 20, more preferably 25, 30, 40, 47, or 50 consecutive nucleotides. In some embodiments, the chip may comprise an array of at least 2, 3, 4, 5, 6, 7, 8 or more of these polynucleotides of the invention. Solid supports and polynucleotides of the present invention attached to solid supports are further described in the section titled "Oligonucleotide probes and Primers".

5) Integrated Systems

Another technique, which may be used to analyze polymorphisms, includes multicomponent integrated systems, which miniaturize and compartmentalize processes such as PCR and capillary electrophoresis reactions in a single functional device. An example of such technique is disclosed in U.S. Pat. No. 5,589,136, the disclosure of which is incorporated herein by reference in its entirety, which describes the integration of PCR amplification and capillary electrophoresis in chips.

Integrated systems can be envisaged mainly when microfluidic systems are used. These systems comprise a pattern of microchannels designed onto a glass, silicon, quartz, or plastic wafer included on a microchip. The movements of the samples are controlled by electric, electroosmotic or hydrostatic forces applied across different areas of the microchip. For genotyping biallelic markers, the microfluidic system may integrate nucleic acid amplification, microsequencing, capillary electrophoresis and a detection method such as laser-induced fluorescence detection.

Methods of Genetic Analysis Using the Biallelic Markers of the Present Invention Different methods are available for the genetic analysis of complex traits (see Lander and Schork, 1994). The search for disease-susceptibility genes is conducted using two main methods: the linkage approach in which evidence is sought for cosegregation between a locus and a putative trait locus using family studies, and the association approach in which evidence is sought for a statistically significant association between an allele and a trait or a trait causing allele (Khoury J. et al, 1993). In general, the biallelic markers of the present invention find use in any method known in the art to demonstrate a statistically significant correlation between a genotype and a phenotype. The biallelic markers may be used in parametric and non-parametric linkage analysis methods. Preferably, the biallelic markers of the present invention are used to identify genes associated with detectable traits using association studies, an approach which does not require the use of affected families and which permits the identification of genes associated with complex and sporadic traits.

The genetic analysis using the biallelic markers of the present invention may be conducted on any scale. The whole set of biallelic markers of the present invention or any subset of biallelic markers of the present invention may be used. In some embodiments a subset of biallelic markers corresponding to one or several candidate genes of the present invention may be used. Alternatively, a subset of biallelic markers of the present invention localised on a specific chromosome segment may be used. Further, any set of genetic markers including a biallelic marker of the present invention may be used. As mentioned above, it should be noted that the biallelic markers of the present invention may be included in any complete or partial genetic map of the human genome. These different uses are specifically contemplated in the present invention and claims.

Linkage Analysis

Linkage analysis is based upon establishing a correlation between the transmission of genetic markers and that of a specific trait throughout generations within a family. Thus, the aim of linkage analysis is to detect marker loci that show cosegregation with a trait of interest in pedigrees.

Parametric Methods

When data are available from successive generations there is the opportunity to study the degree of linkage between pairs of loci. Estimates of the recombination fraction enable loci to be ordered and placed onto a genetic map. With loci that are genetic markers, a genetic map can be established, and then the strength of linkage between markers and traits can be calculated and used to indicate the relative positions of markers and genes affecting those traits (Weir, B. S., 1996). The classical method for linkage analysis is the logarithm of odds (lod) score method (see Morton N. E., 1955; Ott J, 1991). Calculation of lod scores requires specification of the mode of inheritance for the disease (parametric method). Generally, the length of the candidate region identified using linkage analysis is between 2 and 20 Mb. Once a candidate region is identified as described above, analysis of recombinant individuals using additional markers allows further delineation of the candidate region. Linkage analysis studies have generally relied on the use of a maximum of 5,000 microsatellite markers, thus limiting the maximum theoretical attainable resolution of linkage analysis to about 600 kb on average.

Linkage analysis has been successfully applied to map simple genetic traits that show clear Mendelian inheritance patterns and which have a high penetrance (i.e., the ratio between the number of trait positive carriers of allele a and the total number of a carriers in the population). However, parametric linkage analysis suffers from a variety of drawbacks. First, it is limited by its reliance on the choice of a genetic model suitable for each studied trait. Furthermore, as already mentioned, the resolution attainable using linkage analysis is limited, and complementary studies are required to refine the analysis of the typical 2 Mb to 20 Mb regions initially identified through linkage analysis. In addition, parametric linkage analysis approaches have proven difficult when applied to complex genetic traits, such as those due to the combined action of multiple genes and/or environmental factors. It is very difficult to model these factors adequately in a lod score analysis. In such cases, too large an effort and cost are needed to recruit the adequate number of affected families required for applying linkage analysis to these situations, as recently discussed by Risch, N. and Merikangas, K. (1996), the disclosure of which is incorporated herein by reference.

Non-parametric Methods

The advantage of the so-called non-parametric methods for linkage analysis is that they do not require specification of the mode of inheritance for the disease, they tend to be more useful for the analysis of complex traits. In non-parametric methods, one tries to prove that the inheritance pattern of a chromosomal region is not consistent with random Mendelian segregation by showing that affected relatives inherit identical copies of the region more often than expected by chance. Affected relatives should show excess "allele sharing" even in the presence of incomplete penetrance and polygenic inheritance. In non-parametric linkage analysis the degree of agreement at a marker locus in two individuals can be measured either by the number of alleles identical by state (IBS) or by the number of alleles identical by descent (IBD). Affected sib pair analysis is a well-known special case and is the simplest form of these methods.

The biallelic markers of the present invention may be used in both parametric and non-parametric linkage analysis. Preferably biallelic markers may be used in non-parametric methods which allow the mapping of genes involved in complex traits. The biallelic markers of the present invention may be used in both IBD- and IBS-methods to map genes affecting a complex trait. In such studies, taking advantage of the high density of biallelic markers, several adjacent biallelic marker loci may be pooled to achieve the efficiency attained by multi-allelic markers (Zhao et al., 1998, incorporated herein by reference).

However, both parametric and non-parametric linkage analysis methods analyse affected relatives, they tend to be of limited value in the genetic analysis of drug responses or in the analysis of side effects to treatments. This type of analysis is impractical in such cases due to the lack of availability of familial cases. In fact, the likelihood of having more than one individual in a family being exposed to the same drug at the same time is extremely low.

Population Association Studies

The present invention comprises methods for identifying one or several genes among a set of candidate genes that are associated with a detectable trait using the biallelic markers of the present invention. In one embodiment the present invention comprises methods to detect an association between a biallelic marker allele or a biallelic marker haplotype and a trait. Further, the invention comprises methods to identify a trait causing allele in linkage disequilibrium with any biallelic marker allele of the present invention.

As described above, alternative approaches can be employed to perform association studies: genome-wide association studies, candidate region association studies and candidate gene association studies. The candidate region analysis clearly provides a short-cut approach to the identification of genes and gene polymorphisms related to a particular trait when some information concerning the biology of the trait is available. Further, the biallelic markers of the present invention may be incorporated in any map of genetic markers of the human genome in order to perform genome-wide association studies. Methods to generate a high-density map of biallelic markers has been described in U.S. Provisional Patent application serial No. 60/082,614, incorporated herein by reference. The biallelic markers of the present invention may further be incorporated in any map of a specific candidate region of the genome (a specific chromosome or a specific chromosomal segment for example).

As mentioned above, association studies may be conducted within the general population and are not limited to studies performed on related individuals in affected families. Association studies are extremely valuable as they permit the analysis of sporadic or multifactor traits. Moreover, association studies represent a powerful method for fine-scale mapping enabling much finer mapping of trait causing alleles than linkage studies. Studies based on pedigrees often only narrow the location of the trait causing allele. Association studies using the biallelic markers of the present invention can therefore be used to refine the location of a trait causing allele in a candidate region identified by Linkage Analysis methods. Biallelic markers of the present invention can be used to identify the involved gene; such uses are specifically contemplated in the present invention and claims.

1) Determining the Frequency of a Biallelic Marker Allele or of a Biallelic Marker Haplotype in a Population Another embodiment of the present invention encompasses methods of estimating the frequency of a haplotype for a set of biallelic markers in a population, comprising the steps of: a) genotyping each individual in said population for at least one 13q31-q33-related biallelic marker, b) genotyping each individual in said population for a second biallelic marker by determining the identity of the nucleotides at said second biallelic marker for both copies of said second biallelic marker present in the genome; and c) applying a haplotype determination method to the identities of the nucleotides determined in steps a) and b) to obtain an estimate of said frequency. In addition, the methods of estimating the frequency of a haplotype of the invention encompass methods with any further limitation described in this disclosure, or those following, specified alone or in any combination: optionally said haplotype determination method is selected from the group consisting of asymmetric PCR amplification, double PCR amplification of specific alleles, the Clark method, or an expectation maximization algorithm; optionally, said second biallelic marker is a 13q31-q33-related biallelic marker in a sequence selected from the group consisting of SEQ ID Nos 1 to 26, 36 to 40 and 54 to 229, and the complements thereof; optionally, said 13q31-q33-related biallelic marker may be selected individually or in any combination from the biallelic markers described in Tables 6b and 6c; optionally, the identity of the nucleotides at the biallelic markers in everyone of the sequences of SEQ ID Nos 1 to 26, 36 to 40 and 54 to 229 is determined in steps a) and b).

Association Studies Explore the Relationships Among Frequencies for Sets of Alleles Between Loci Determining the Frequency of an Allele in a Population Allelic frequencies of the biallelic markers in a population can be determined using one of the methods described above under the heading "Methods for genotyping an individual for biallelic markers", or any genotyping procedure suitable for this intended purpose. Genotyping pooled samples or individual samples can determine the frequency of a biallelic marker allele in a population. One way to reduce the number of genotypings required is to use pooled samples. A major obstacle in using pooled samples is in terms of accuracy and reproducibility for determining accurate DNA concentrations in setting up the pools. Genotyping individual samples provides higher sensitivity, reproducibility and accuracy and; is the preferred method used in the present invention. Preferably, each individual is genotyped separately and simple gene counting is applied to determine the frequency of an allele of a biallelic marker or of a genotype in a given population.

Determining the Frequency of a Haplotype in a Population

The gametic phase of haplotypes is unknown when diploid individuals are heterozygous at more than one locus. Using genealogical information in families gametic phase can sometimes be inferred (Perlin et al., 1994, incorporated herein by reference). When no genealogical information is available different strategies may be used. One possibility is that the multiple-site heterozygous diploids can be eliminated from the analysis, keeping only the homozygotes and the single-site heterozygote individuals, but this approach might lead to a possible bias in the sample composition and the underestimation of low-frequency haplotypes. Another possibility is that single chromosomes can be studied independently, for example, by asymmetric PCR amplification (see Newton et al., 1989; Wu et al., 1989) or by isolation of single chromosome by limit dilution followed by PCR amplification (see Ruano et al., 1990). Each of these disclosures in incorporated herein by reference. Further, a sample may be haplotyped for sufficiently close biallelic markers by double PCR amplification of specific alleles (Sarkar, G. and Sommer S. S., 1991, incorporated herein by reference). These approaches are not entirely satisfying either because of their technical complexity, the additional cost they entail, their lack of generalisation at a large scale, or the possible biases they introduce. To overcome these difficulties, an algorithm to infer the phase of PCR-amplified DNA genotypes introduced by Clark A. G. (1990), incorporated herein by reference may be used. Briefly, the principle is to start filling a preliminary list of haplotypes present in the sample by examining unambiguous individuals, that is, the complete homozygotes and the single-site heterozygotes. Then other individuals in the same sample are screened for the possible occurrence of previously recognised haplotypes. For each positive identification, the complementary haplotype is added to the list of recognised haplotypes, until the phase information for all individuals is either resolved or identified as unresolved. This method assigns a single haplotype to each multiheterozygous individual, whereas several haplotypes are possible when there are more than one heterozygous site. Alternatively, one can use methods estimating haplotype frequencies in a population without assigning haplotypes to each individual. Preferably, a method based on an expectation-maximization (EM) algorithm (Dempster et al., J. R. 1977, incorporated herein by reference) leading to maximum-likelihood estimates of haplotype frequencies under the assumption of Hardy-Weinberg proportions (random mating) is used (see Excoffier L. and Slatkin M., 1995, incorporated herein by reference). The EM algorithm is a generalised iterative maximum-likelihood approach to estimation that is useful when data are ambiguous and/or incomplete. The EM algorithm is used to resolve heterozygotes into haplotypes. Haplotype estimations are further described below under the heading "Statistical methods>>. Any other method known in the art to determine or to estimate the frequency of a haplotype in a population may also be used.

2) Linkage Disequilibrium Analysis

Linkage disequilibrium is the non-random association of alleles at two or more loci and represents a powerful tool for mapping genes involved in disease traits (see Ajioka R. S. et al., 1997, incorporated herein by reference). Biallelic markers, because they are densely spaced in the human genome and can be genotyped in more numerous numbers than other types of genetic markers (such as RFLP or VNTR markers), are particularly useful in genetic analysis based on linkage disequilibrium. The biallelic markers of the present invention may be used in any linkage disequilibrium analysis method known in the art.

Briefly, when a disease mutation is first introduced into a population (by a new mutation or the immigration of a mutation carrier), it necessarily resides on a single chromosome and thus on a single "background" or "ancestral" haplotype of linked markers. Consequently, there is complete disequilibrium between these markers and the disease mutation: one finds the disease mutation only in the presence of a specific set of marker alleles. Through subsequent generations recombinations occur between the disease mutation and these marker polymorphisms, and the disequilibrium gradually dissipates. The pace of this dissipation is a function of the recombination frequency, so the markers closest to the disease gene will manifest higher levels of disequilibrium than those that are further away. When not broken up by recombination, "ancestral" haplotypes and linkage disequilibrium between marker alleles at different loci can be tracked not only through pedigrees but also through populations. Linkage disequilibrium is usually seen as an association between one specific allele at one locus and another specific allele at a second locus.

The pattern or curve of disequilibrium between disease and marker loci is expected to exhibit a maximum that occurs at the disease locus. Consequently, the amount of linkage disequilibrium between a disease allele and closely linked genetic markers may yield valuable information regarding the location of the disease gene. For fine-scale mapping of a disease locus, it is useful to have some knowledge of the patterns of linkage disequilibrium that exist between markers in the studied region. As mentioned above the mapping resolution achieved through the analysis of linkage disequilibrium is much higher than that of linkage studies. The high density of biallelic markers combined with linkage disequilibrium analysis provides powerful tools for fine-scale mapping. Different methods to calculate linkage disequilibrium are described below under the heading "Statistical Methods".

3) Population-based Case-control Studies of Trait-marker Associations

As mentioned above, the occurrence of pairs of specific alleles at different loci on the same chromosome is not random and the deviation from random is called linkage disequilibrium. Association studies focus on population frequencies and rely on the phenomenon of linkage disequilibrium. If a specific allele in a given gene is directly involved in causing a particular trait, its frequency will be statistically increased in an affected (trait positive) population, when compared to the frequency in a trait negative population or in a random control population. As a consequence of the existence of linkage disequilibrium, the frequency of all other alleles present in the haplotype carrying the trait-causing allele will also be increased in trait positive individuals compared to trait negative individuals or random controls. Therefore, association between the trait and any allele (specifically a biallelic marker allele) in linkage disequilibrium with the trait-causing allele will suffice to suggest the presence of a trait-related gene in that particular region. Case-control populations can be genotyped for biallelic markers to identify associations that narrowly locate a trait causing allele. As any marker in linkage disequilibrium with one given marker associated with a trait will be associated with the trait. Linkage disequilibrium allows the relative frequencies in case-control populations of a limited number of genetic polymorphisms (specifically biallelic markers) to be analysed as an alternative to screening all possible functional polymorphisms in order to find trait-causing alleles. Association studies compare the frequency of marker alleles in unrelated case-control populations, and represent powerful tools for the dissection of complex traits.

Case-control Populations (Inclusion Criteria)

Population-based association studies do not concern familial inheritance but compare the prevalence of a particular genetic marker, or a set of markers, in case-control populations. They are case-control studies based on comparison of unrelated case (affected or trait positive) individuals and unrelated control (unaffected or trait negative or random) individuals. Preferably the control group is composed of unaffected or trait negative individuals. Further, the control group is ethnically matched to the case population. Moreover, the control group is preferably matched to the case-population for the main known confusion factor for the trait under study (for example age-matched for an age-dependent trait). Ideally, individuals in the two samples are paired in such a way that they are expected to differ only in their disease status. In the following "trait positive population>>, "case population" and "affected population" are used interchangeably.

An important step in the dissection of complex traits using association studies is the choice of case-control populations (see Lander and Schork, 1994). A major step in the choice of case-control populations is the clinical definition of a given trait or phenotype. Any genetic trait may be analysed by the association method proposed here by carefully selecting the individuals to be included in the trait positive and trait negative phenotypic groups. Four criteria are often useful: clinical phenotype, age at onset, family history and severity. The selection procedure for continuous or quantitative traits (such as blood pressure for example) involves selecting individuals at opposite ends of the phenotype distribution of the trait under study, so as to include in these trait positive and trait negative populations individuals with non-overlapping phenotypes. Preferably, case-control populations comprise phenotypically homogeneous populations. Trait positive and trait negative populations comprise phenotypically uniform populations of individuals representing each between 1 and 98%, preferably between 1 and 80%, more preferably between 1 and 50%, and more preferably between 1 and 30%, most preferably between 1 and 20% of the total population under study, and selected among individuals exhibiting non-overlapping phenotypes. The clearer the difference between the two trait phenotypes, the greater the probability of detecting an association with biallelic markers. The selection of those drastically different but relatively uniform phenotypes enables efficient comparisons in association studies and the possible detection of marked differences at the genetic level, provided that the sample sizes of the populations under study are significant enough.

In preferred embodiments, a first group of between 50 and 300 trait positive individuals, preferably about 100 individuals, are recruited according to their phenotypes. A similar number of trait negative individuals are included in such studies.

In the present invention, typical examples of inclusion criteria include affection by schizophrenia.

Association Analysis

The general strategy to perform association studies using biallelic markers derived from a region carrying a candidate gene is to scan two groups of individuals (case-control populations) in order to measure and statistically compare the allele frequencies of the biallelic markers of the present invention in both groups.

If a statistically significant association with a trait is identified for at least one or more of the analysed biallelic markers, one can assume that: either the associated allele is directly responsible for causing the trait (the associated allele is the trait causing allele), or more likely the associated allele is in linkage disequilibrium with the trait causing allele. The specific characteristics of the associated allele with respect to the gene function usually gives further insight into the relationship between the associated allele and the trait (causal or in linkage disequilibrium). If the evidence indicates that the associated allele within the gene is most probably not the trait causing allele but is in linkage disequilibrium with the real trait causing allele, then the trait causing allele can be found by sequencing the vicinity of the associated marker.

Another embodiment of the present invention encompasses methods of detecting an association between a haplotype and a phenotype, comprising the steps of: a) estimating the frequency of at least one haplotype in a trait positive population according to a method of estimating the frequency of a haplotype of the invention; b) estimating the frequency of said haplotype in a control population according to the method of estimating the frequency of a haplotype of the invention; and c) determining whether a statistically significant association exists between said haplotype and said phenotype. In addition, the methods of detecting an association between a haplotype and a phenotype of the invention encompass methods with any further limitation described in this disclosure, or those following, specified alone or in any combination: Optionally, said 13q31-q33-related biallelic marker may be in a sequence selected individually or in any combination from the group consisting of SEQ ID Nos 1 to 26, 36 to 40 and 54 to 229, and the complements thereof; optionally, said 13q31-q33-related biallelic marker may be selected individually or in any combination from the biallelic markers described in Tables 6b and 6c; optionally, said control population may be a trait negative population, or a random population; optionally, said phenotype is a disease involving schizophrenia, a response to an agent acting on schizophrenia, or a side effects to an agent acting on schizophrenia.

Haplotype Analysis

As described above, when a chromosome carrying a disease allele first appears in a population as a result of either mutation or migration, the mutant allele necessarily resides on a chromosome having a set of linked markers: the ancestral haplotype. This haplotype can be tracked through populations and its statistical association with a given trait can be analysed. Complementing single point (allelic) association studies with multi-point association studies also called haplotype studies increases the statistical power of association studies. Thus, a haplotype association study allows one to define the frequency and the type of the ancestral carrier haplotype. A haplotype analysis is important in that it increases the statistical power of an analysis involving individual markers.

In a first stage of a haplotype frequency analysis, the frequency of the possible haplotypes based on various combinations of the identified biallelic markers of the invention is determined. The haplotype frequency is then compared for distinct populations of trait positive and control individuals. The number of trait positive individuals, which should be, subjected to this analysis to obtain statistically significant results usually ranges between 30 and 300, with a preferred number of individuals ranging between 50 and 150. The same considerations apply to the number of unaffected individuals (or random control) used in the study. The results of this first analysis provide haplotype frequencies in case-control populations, for each evaluated haplotype frequency a p-value and an odd ratio are calculated. If a statistically significant association is found the relative risk for an individual carrying the given haplotype of being affected with the trait under study can be approximated.

Interaction Analysis

The biallelic markers of the present invention may also be used to identify patterns of biallelic markers associated with detectable traits resulting from polygenic interactions. The analysis of genetic interaction between alleles at unlinked loci requires individual genotyping using the techniques described herein. The analysis of allelic interaction among a selected set of biallelic markers with appropriate level of statistical significance can be considered as a haplotype analysis. Interaction analysis comprises stratifying the case-control populations with respect to a given haplotype for the first loci and performing a haplotype analysis with the second loci with each subpopulation.

Statistical methods used in association studies are further described herein.

4) Testing for Linkage in the Presence of Association

The biallelic markers of the present invention may further be used in TDT (transmission/disequilibrium test). TDT tests for both linkage and association and is not affected by population stratification. TDT requires data for affected individuals and their parents or data from unaffected sibs instead of from parents (see Spielmann S. et al., 1993; Schaid D. J. et al., 1996, Spielmann S. and Ewens W. J, 1998, the disclosures of which are all incorporated herein by reference). Such combined tests generally reduce the false-positive errors produced by separate analyses.

Statistical Methods

In general, any method known in the art to test whether a trait and a genotype show a statistically significant correlation may be used.

1) Methods in Linkage Analysis

Statistical methods and computer programs useful for linkage analysis are well-known to those skilled in the art (see Terwilliger J. D. and Ott J., 1994; Ott J., 1991, each incorporated herein by reference).

2) Methods to Estimate Haplotype Frequencies in a Population

As described above, when genotypes are scored, it is often not possible to distinguish heterozygotes so that haplotype frequencies cannot be easily inferred. When the gametic phase is not known, haplotype frequencies can be estimated from the multilocus genotypic data. Any method known to person skilled in the art can be used to estimate haplotype frequencies (see Lange K., 1997; Weir, B. S., 1996) Preferably, maximum-likelihood haplotype frequencies are computed using an Expectation-Maximization (EM) algorithm (see Dempster et al., 1977; Excoffier L. and Slatkin M., 1995). This procedure is an iterative process aiming at obtaining maximum-likelihood estimates of haplotype frequencies from multi-locus genotype data when the gametic phase is unknown. Haplotype estimations are usually performed by applying the EM algorithm using for example the EM-HAPLO program (Hawley M. E. et al., 1994) or the Arlequin program (Schneider et al., 1997). The EM algorithm is a generalised iterative maximum likelihood approach to estimation and is briefly described below. The disclosures of these publication are incorporated herein by reference.

In the following part of this text, phenotypes will refer to multi-locus genotypes with unknown phase. Genotypes will refer to known-phase multi-locus genotypes. Suppose a sample of N unrelated individuals typed for K markers. The data observed are the unknown-phase K-locus phenotypes that can categorised in F different phenotypes. Suppose that we have H underlying possible haplotypes (in case of K biallelic markers, $H=2^K$).

For phenotype j, suppose that $c_j$ genotypes are possible. We thus have the following equation $$P_j = \sum_{i=1}^{c_j} pr(genotype_i) = \sum_{i=1}^{c_j} pr(h_k, h_l) \quad \text{Equation 1}$$

where Pj is the probability of the phenotype j, $h_k$ and $h_l$ are the two haplotypes constituent the genotype i. Under the Hardy-Weinberg equilibrium, $pr(h_k,h_l)$ becomes:

$$pr(h_k, h_l) = pr(h_k)^2 \quad \text{if } h_k = h_l, \quad \text{Equation 2}$$
$$pr(h_k, h_l) = 2pr(h_k) \cdot pr(h_l) \quad \text{if } h_k \neq h_l.$$

The successive steps of the E-M algorithm can be described as follows:

Starting with initial values of the of haplotypes frequencies, noted $p_1^{(0)}, p_2^{(0)}, \ldots p_H^{(0)}$, these initial values serve to estimate the genotype frequencies (Expectation step) and then estimate another set of haplotype frequencies (Maximisation step), noted $p_1^{(1)}, p_2^{(1)}, \ldots p_H^{(1)}$, these two steps are iterated until changes in the sets of haplotypes frequency are very small.

A stop criterion can be that the maximum difference between haplotype frequencies between two iterations is less than $10^{-7}$. These values can be adjusted according to the desired precision of estimations. In details, at a given iteration s, the Expectation step comprises calculating the genotypes frequencies by the following equation:

$$pr(genotype_i)^{(s)} = pr(phenotype_j) \cdot \quad \text{Equation 3}$$
$$pr(genotype_i \mid phenotype_j)^{(s)}$$
$$= \frac{n_j}{N} \cdot \frac{pr(h_k, h_l)^{(s)}}{P_j^{(s)}}$$

where genotype i occurs in phenotype j, and where $h_k$ and $h_l$ constitute genotype i. Each probability is derived according to eq.1, and eq.2 described above.

Then the Maximisation step simply estimates another set of haplotype frequencies given the genotypes frequencies. This approach is also known as gene-counting method (Smith, 1957).

$$p_t^{(s+1)} = \frac{1}{2} \sum_{j=1}^{F} \sum_{i=1}^{c_j} \delta_{it} \cdot pr(genotype_i)^{(s)} \quad \text{Equation 4}$$

Where $\delta_{it}$ is an indicator variable which count the number of time haplotype t in genotype i. It takes the values of 0, 1 or 2.

To ensure that the estimation finally obtained is the maximum-likelihood estimation several values of departures are required. The estimations obtained are compared and if they are different the estimations leading to the best likelihood are kept.

3) Methods to Calculate Linkage Disequilibrium Between Markers

A number of methods can be used to calculate linkage disequilibrium between any two genetic positions, in practice linkage disequilibrium is measured by applying a statistical association test to haplotype data taken from a population. Linkage disequilibrium between any pair of biallelic markers comprising at least one of the biallelic markers of the present invention ($M_i$, $M_j$) having alleles ($a_i/b_i$) at marker $M_i$ and alleles ($a_j/b_j$) at marker $M_j$ can be calculated for every allele combination ($a_i,a_j$; $a_i,b_j$; $b_i,a_j$ and $b_i,b_j$), according to the Piazza formula:

$$\Delta_{a_ia_j} = \sqrt{\theta 4} - \sqrt{(\theta 4 + \theta 3)(\theta 4 + \theta 2)}, \text{ where:}$$

$\theta 4 = -- =$ frequency of genotypes not having allele $a_i$ at $M_i$ and not having allele $a_j$ at $M_j$ $\theta 3 = -+ =$ frequency of genotypes not having allele $a_i$ at $M_i$ and having allele $a_j$ at $M_j$ $\theta 2 = +- =$ frequency of genotypes having allele $a_i$ at $M_i$ and not having allele $a_j$ at $M_j$ Linkage disequilibrium (LD) between pairs of biallelic markers ($M_i$, $M_j$) can also be calculated for every allele combination (ai,aj; ai,bj; $b_i,a_j$ and $b_i,b_j$), according to the maximum-likelihood estimate (MLE) for delta (the composite genotypic disequilibrium coefficient), as described by Weir (Weir B. S., 1996). The MLE for the composite linkage disequilibrium is:

$$D_{a_ia_j} = (2n_1 + n_2 + n_3 + n_4/2)/N - 2(pr(a_i) \cdot pr(a_j))$$

where $n_1 = \Sigma$ phenotype ($a_i/a_i$, $a_j/a_j$), $n_2 = \Sigma$ phenotype ($a_i/a_i$, $a_j/b_j$), $n_3 = \Sigma$ phenotype ($a_i/b_i$, $a_j/a_j$), $n4 = \Sigma$ phenotype ($a_i/b_i$, $a_j/b_j$) and N is the number of individuals in the sample. This formula allows linkage disequilibrium between alleles to be estimated when only genotype, and not haplotype, data are available.

Another means of calculating the linkage disequilibrium between markers is as follows. For a couple of biallelic markers, $M_i(a_i/b_i)$ and $M_j(a_j/b_j)$, fitting the Hardy-Weinberg equilibrium, one can estimate the four possible haplotype frequencies in a given population according to the approach described above.

The estimation of gametic disequilibrium between ai and aj is simply:

$$D_{a_ia_j} = pr(haplotype(a_i, a_j)) - pr(a_i) \cdot pr(a_j).$$

Where $pr(a_i)$ is the probability of allele $a_i$ and $pr(a_j)$ is the probability of allele $a_j$ and where $pr(haplotype (a_i, a_j))$ is estimated as in Equation 3 above.

For a couple of biallelic marker only one measure of disequilibrium is necessary to describe the association between $M_i$ and $M_j$.

Then a normalised value of the above is calculated as follows:

$$D'_{a_ia_j} = D_{a_ia_j} / \max(-pr(a_i) \cdot pr(a_j), -pr(b_i) \cdot pr(b_j)) \text{ with } D_{a_ia_j} < 0$$

$$D'_{a_ia_j} = D_{a_ia_j} / \max(pr(b_i) \cdot pr(a_j), pr(a_i) \cdot pr(b_j)) \text{ with } D_{a_ia_j} > 0$$

The skilled person will readily appreciate that other LD calculation methods can be used without undue experimentation.

Linkage disequilibrium among a set of biallelic markers having an adequate heterozygosity rate can be determined by genotyping between 50 and 1000 unrelated individuals, preferably between 75 and 200, more preferably around 100.

4) Testing for Association

Methods for determining the statistical significance of a correlation between a phenotype and a genotype, in this case an allele at a biallelic marker or a haplotype made up of such alleles, may be determined by any statistical test known in the art and with any accepted threshold of statistical significance being required. The application of particular methods and thresholds of significance are well with in the skill of the ordinary practitioner of the art.

Testing for association is performed by determining the frequency of a biallelic marker allele in case and control populations and comparing these frequencies with a statistical test to determine if their is a statistically significant difference in frequency which would indicate a correlation between the trait and the biallelic marker allele under study. Similarly, a haplotype analysis is performed by estimating the frequencies of all possible haplotypes for a given set of biallelic markers in case and control populations, and comparing these frequencies with a statistical test to determine if their is a statistically significant correlation between the haplotype and the phenotype (trait) under study. Any statistical tool useful to test for a statistically significant association between a genotype and a phenotype may be used. Preferably the statistical test employed is a chi-square test with one degree of freedom. A P-value is calculated (the P-value is the probability that a statistic as large or larger than the observed one would occur by chance).

Statistical Significance

In preferred embodiments, significance for diagnosis purposes, either as a positive basis for further diagnostic tests or as a preliminary starting point for early preventive therapy, the p value related to a biallelic marker association is preferably about $1 \times 10^{-2}$ or less, more preferably about $1 \times 10^{-4}$ or less, for a single biallelic marker analysis and about $1 \times 10^{-3}$ or less, still more preferably $1 \times 10^{-6}$ or less and most preferably of about $1 \times 10^{-8}$ or less, for a haplotype analysis involving several markers. These values are believed to be applicable to any association studies involving single or multiple marker combinations.

The skilled person can use the range of values set forth above as a starting point in order to carry out association studies with biallelic markers of the present invention. In doing so, significant associations between the biallelic markers of the present invention and diseases involving schizophrenia can be revealed and used for diagnosis and drug screening purposes.

Phenotypic Permutation

In order to confirm the statistical significance of the first stage haplotype analysis described above, it might be suitable to perform further analyses in which genotyping data from case-control individuals are pooled and randomised with respect to the trait phenotype. Each individual genotyping data is randomly allocated to two groups, which contain the same number of individuals as the case-control populations used to compile the data obtained in the first stage. A second stage haplotype analysis is preferably run on these artificial groups, preferably for the markers included in the haplotype of the first stage analysis showing the highest relative risk coefficient. This experiment is reiterated preferably at least between 100 and 10000 times. The repeated iterations allow the determination of the percentage of obtained haplotypes with a significant p-value level.

Assessment of Statistical Association

To address the problem of false positives similar analysis may be performed with the same case-control populations in random genomic regions. Results in random regions and the candidate region are compared as described in US Provisional Patent Application entitled "Methods, software and apparati for identifying genomic regions harbouring a gene associated with a detectable trait".

5) Evaluation of Risk Factors

The association between a risk factor (in genetic epidemiology the risk factor is the presence or the absence of a certain allele or haplotype at marker loci) and a disease is measured by the odds ratio (OR) and by the relative risk (RR). If $P(R^+)$ is the probability of developing the disease for individuals with R and $P(R^-)$ is the probability for individuals without the risk factor, then the relative risk is simply the ratio of the two probabilities, that is:

$$RR = P(R^+)/P(R^-)$$

In case-control studies, direct measures of the relative risk cannot be obtained because of the sampling design. However, the odds ratio allows a good approximation of the relative risk for low-incidence diseases and can be calculated:

$$OR = \left[\frac{F^+}{1-F^+}\right] / \left[\frac{F^-}{(1-F^-)}\right]$$

$F^+$ is the frequency of the exposure to the risk factor in cases and $F^-$ is the frequency of the exposure to the risk factor in controls. $F^+$ and $F^-$ are calculated using the allelic or haplotype frequencies of the study and further depend on the underlying genetic model (dominant, recessive, additive . . . ).

One can further estimate the attributable risk (AR) which describes the proportion of individuals in a population exhibiting a trait due to a given risk factor. This measure is important in quantitating the role of a specific factor in disease etiology and in terms of the public health impact of a risk factor. The public health relevance of this measure lies in estimating the proportion of cases of disease in the population that could be prevented if the exposure of interest were absent. AR is determined as follows:

$$AR = P_E(RR-1)/(P_E(RR-1)+1)$$

AR is the risk attributable to a biallelic marker allele or a biallelic marker haplotype. $P_E$ is the frequency of exposure to an allele or a haplotype within the population at large; and RR is the relative risk which, is approximated with the odds ratio when the trait under study has a relatively low incidence in the general population.

AR is the risk attributable to a biallelic marker allele or a biallelic marker haplotype. $P_E$ is the frequency of exposure to an allele or a haplotype within the population at large; and RR is the relative risk which, is approximated with the odds ratio when the trait under study has a relatively low incidence in the general population.

Association of Biallelic Markers of the Invention with Schizophrenia

In the context of the present invention, an association between chromosome 13q31-q33-related biallelic markers, including Region D biallelic markers, and schizophrenia and bipolar disorder were established. Several association studies using different populations and screening samples thereof, and with different sets of biallelic markers distributed on the chromosome 13q31-q33 region and Region D thereof were carried out. Further details concerning these association studies and the results are provided herein in Examples 5a to 5e.

This information is extremely valuable. The knowledge of a potential genetic predisposition to schizophrenia, even if this predisposition is not absolute, might contribute in a very significant manner to treatment efficacy of schizophrenia and to the development of new therapeutic and diagnostic tools.

Identification of Biallelic Markers in Linkage Disequilibrium with the Biallelic Markers of the Invention Once a first biallelic marker has been identified in a genomic region of interest, the practitioner of ordinary skill in the art, using the teachings of the present invention, can easily identify additional biallelic markers in linkage disequilibrium with this first marker. As mentioned before, any marker in linkage disequilibrium with a first marker associated with a trait will be associated with the trait. Therefore, once an association has been demonstrated between a given biallelic marker and a trait, the discovery of additional biallelic markers associated with this trait is of great interest in order to increase the density of biallelic markers in this particular region. The causal gene or mutation will be found in the vicinity of the marker or set of markers showing the highest correlation with the trait.

Identification of additional markers in linkage disequilibrium with a given marker involves: (a) amplifying a genomic fragment comprising a first biallelic marker from a plurality of individuals; (b) identifying of second biallelic markers in the genomic region harboring said first biallelic marker; (c) conducting a linkage disequilibrium analysis between said first biallelic marker and second biallelic markers; and (d) selecting said second biallelic markers as being in linkage disequilibrium with said first marker. Subcombinations comprising steps (b) and (c) are also contemplated.

Methods to identify biallelic markers and to conduct linkage disequilibrium analysis are described herein and can be carried out by the skilled person without undue experimentation. The present invention then also concerns biallelic markers and other polymorphisms which are in linkage disequilibrium with the specific biallelic markers of the invention and which are expected to present similar characteristics in terms of their respective association with a given trait. In a preferred embodiment, the invention concerns biallelic markers which are in linkage disequilibrium with the specific biallelic markers.

Identification of Functional Mutations

Once a positive association is confirmed with a biallelic marker of the present invention, the associated candidate gene sequence can be scanned for mutations by comparing the sequences of a selected number of trait positive and trait negative individuals. In a preferred embodiment, functional regions such as exons and splice sites, promoters and other regulatory regions of the gene are scanned for mutations. Preferably, trait positive individuals carry the haplotype shown to be associated with the trait and trait negative individuals do not carry the haplotype or allele associated with the trait. The mutation detection procedure is essentially similar to that used for biallelic site identification.

The method used to detect such mutations generally comprises the following steps: (a) amplification of a region of the candidate DNA sequence comprising a biallelic marker or a group of biallelic markers associated with the trait from DNA samples of trait positive patients and trait negative controls; (b) sequencing of the amplified region; (c) comparison of DNA sequences from trait-positive patients and trait-negative controls; and (d) determination of mutations specific to trait-positive patients. Subcombinations which comprise steps (b) and (c) are specifically contemplated.

It is preferred that candidate polymorphisms be then verified by screening a larger population of cases and controls by means of any genotyping procedure such as those described herein, preferably using a microsequencing technique in an individual test format. Polymorphisms are considered as candidate mutations when present in cases and controls at frequencies compatible with the expected association results.

Candidate polymorphisms and mutations of the sbg1 nucleic acid sequences suspected of being involved in a predisposition to schizophrenia can be confirmed by screening a larger population of affected and unaffected individuals using any of the genotyping procedures described herein. Preferably the microsequencing technique is used. Such polymorphisms are considered as candidate "trait-causing" mutations when they exhibit a statistically significant correlation with the detectable phenotype.

Biallelic Markers of the Invention in Methods of Genetic Diagnostics

The biallelic markers and other polymorphisms of the present invention can also be used to develop diagnostics tests capable of identifying individuals who express a detectable trait as the result of a specific genotype or individuals whose genotype places them at risk of developing a detectable trait at a subsequent time. The trait analyzed using the present diagnostics may be any detectable trait, including predisposition to schizophrenia, age of onset of detectable symptoms, a beneficial response to or side effects related to treatment against schizophrenia. Such a diganosis can be useful in the monitoring, prognosis and/or prophylactic or curative therapy for schizophrenia.

The diagnostic techniques of the present invention may employ a variety of methodologies to determine whether a test subject has a genotype associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids.

The diagnostic techniques concern the detection of specific alleles present within the human chromosome 13q31-q33 region; optionally within the Region D subregion; and optionally within an sbg1, g34665, sbg2, g35017 or g35018 nucleic acid sequence. More particularly, the invention concerns the detection of a nucleic acid comprising at least one of the nucleotide sequences of SEQ ID Nos. 1 to 26, 36 to 40 and 54 to 229 or a fragment thereof or a complementary sequence thereto including the polymorphic base.

These methods involve obtaining a nucleic acid sample from the individual and, determining, whether the nucleic acid sample contains at least one allele or at least one biallelic marker haplotype, indicative of a risk of developing the trait or indicative that the individual expresses the trait as a result of possessing a particular the human chromosome 13q31-q33 region, Region D, sbg1, g34665, sbg2, g35017 or g35018-related polymorphism or mutation (trait-causing allele).

Preferably, in such diagnostic methods, a nucleic acid sample is obtained from the individual and this sample is genotyped using methods described above in "Methods Of Genotyping DNA Samples For Biallelic markers." The diagnostics may be based on a single biallelic marker or a on group of biallelic markers.

In each of these methods, a nucleic acid sample is obtained from the test subject and the biallelic marker pattern of one or more of the biallelic markers of the invention is determined.

In one embodiment, a PCR amplification is conducted on the nucleic acid sample to amplify regions in which polymorphisms associated with a detectable phenotype have been identified. The amplification products are sequenced to determine whether the individual possesses one or more human chromosome 13q31-q33 region, Region D, sbg1, g34665, sbg2, g35017 or g35018-related polymorphisms associated with a detectable phenotype. The primers used to generate amplification products may comprise the primers listed in Table 6a. Alternatively, the nucleic acid sample is subjected to microsequencing reactions as described above to determine whether the individual possesses one or more human chromosome 13q31-q33 region-related polymorphisms associated with a detectable phenotype resulting from a mutation or a polymorphism in the human chromosome 13q31-q33 region, Region D, sbg1, g34665, sbg2, g35017 or g35018-related biallelic marker. The primers used in the microsequencing reactions may include the primers listed in 6d. In another embodiment, the nucleic acid sample is contacted with one or more allele specific oligonucleotide probes which, specifically hybridize to one or more human chromosome 13q31-q33 region, Region D, sbg1, g34665, sbg2, g35017 or g35018-related alleles associated with a detectable phenotype. The probes used in the hybridization assay may include the probes listed in Table 6c. In another embodiment, the nucleic acid sample is contacted with a second oligonucleotide capable of producing an amplification product when used with the allele specific oligonucleotide in an amplification reaction. The presence of an amplification product in the amplification reaction indicates that the individual possesses one or more human chromosome 13q31-q33 region, Region D, sbg1, g34665, sbg2, g35017 or g35018-related alleles associated with a detectable phenotype.

In a preferred embodiment the identity of the nucleotide present at, at least one, biallelic marker selected from the group consisting of A1 to A69, A71 to A74, A76 to A94, A96 to A106, A108 to A112, A114 to A177, A179 to A197, A199 to A222, A224 to A246, A250, A251, A253, A255, A259, A266, A268 to A232, A328 to A360 and A361 to A489 and the complements thereof, is determined and the detectable trait is schizophrenia. Diagnostic kits comprise any of the polynucleotides of the present invention.

These diagnostic methods are extremely valuable as they can, in certain circumstances, be used to initiate preventive treatments or to allow an individual carrying a significant haplotype to foresee warning signs such as minor symptoms.

Diagnostics, which analyze and predict response to a drug or side effects to a drug, may be used to determine whether an individual should be treated with a particular drug. For example, if the diagnostic indicates a likelihood that an individual will respond positively to treatment with a particular drug, the drug may be administered to the individual. Conversely, if the diagnostic indicates that an individual is likely to respond negatively to treatment with a particular drug, an alternative course of treatment may be prescribed. A negative response may be defined as either the absence of an efficacious response or the presence of toxic side effects.

Clinical drug trials represent another application for the markers of the present invention. One or more markers indicative of response to an agent acting against schizophrenia or to side effects to an agent acting against schizophrenia may be identified using the methods described above. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems.

Prevention, Diagnosis and Treatment of Psychiatric Disease

An aspect of the present invention relates to the preparation of a medicament for the treatment of psychiatric disease, in particular schizophrenia and bipolar disorder. The present invention embodies medicaments acting on sbg1, g34665, sbg2, g35017 or g35018.

In preferred embodiments, medicaments of the invention act on sbg1, either directly or indirectly, by acting on the sbg1 pathways. For example, the medicaments may modulate, and more preferably decrease the level of sbg1 activity which occurs in a cell or particular tissue, or increase or descrease the activity of the sbg1 protein. In certain embodiments, the invention thus comprises use of a compound capable of increasing or decreasing sbg1 expression or sbg1 protein activity in the preparation or manufacture of a medicament. Preferably, said compound is used for the treatment of a psychiatric disease, preferably for the treatment of schizophrenia or bipolar disorder. Preferably, said compound acts directly by binding to sbg1 or an sbg1 receptor.

Such medicaments may also increase or decrease the activity of a compound analogous to sbg1, a compound comprising an amino acid sequence having at least 25% homology to a sequence selected from the group consisting of SEQ ID NOs. 27 to 35, a compound comprising an amino acid sequence having at least 50% homology to a sequence selected from the group consisting of SEQ ID NOs. 27 to 35, and a compound comprising an amino acid sequence having at least 80% homology to a sequence selected from the group consisting of SEQ ID NOs. 27 to 35.

Medicaments which increase or descrease the activity of these compounds in an individual may be used to ameliorate or prevent symptoms in individuals suffering from or predisposed to a psychiatric disease, as discussed above in the section entitled "indications".

Alternatively, sbg1 activity may be increased or decreasing by the expression of the genes encoding the identified sbg1-modulating compounds using gene therapy. Examples of vectors and promoters suitable for use in gene therapy are described above. Sbg1 activity may also be increased or decreased by preparing an antibody which binds to an sbg1 peptide, an sbg1 receptor or a protein related thereto, as well as fragments of these proteins. Such antibodies may modulate the interaction between sbg1 and an sbg1 receptor or a protein related thereto. Antibodies and methods of obtaining them are further described herein.

As described above, the present invention provides cellular assays for identifying compounds for the treatment of psychiatric disease. The assays are based on detection of sbg1 expression, measurement of sbg1 protein activity, or based on the determination of other suitable schizophrenia, bipolar disorder or related psychiatric disease endpoints. Compounds for the treatment of psychiatric disease include derivative proteins or peptides which are capable of inhibiting the activity of a wild type sbg1 protein, which may be identified by determining their ability to bind a wild type sbg1 protein. Compounds also include antibodies, and small molecules and drugs which may be obtained using a variety of synthetic approaches familiar to those skilled in the art, including combinatorial chemistry based techniques.

The invention further encompasses said methods for the prevention, treatment, and diagnosis of disease using any of the g34665, sbg2, g35017 or g35018 nucleic acids of proteins of the invention in analogous methods.

Sbg1 in Methods of Diagnosis or Detecting Predisposition

Individuals affected by or predisposed to schizophrenia and bipolar disorder may express abnormal levels of sbg1, g34665, sbg2, g35017 or g35018. Individuals having increased or decreased sbg1, g34665, sbg2, g35017 or g35018 activity in their plasma, body fluids, or body tissues may be at risk of developing schizophrenia, bipolar disorder or a variety of potentially related psychiatric conditions. In one aspect of the present invention is a method for determining whether an individual is at risk of suffering from or is currently suffering from schizophrenia, bipolar disorder or other psychotic disorders, mood disorders, autism, substance dependence or alcoholism, mental retardation, or other psychiatric diseases including cognitive, anxiety, eating, impulse-control, and personality disorders, as defined with the Diagnosis and Statistical Manual of Mental Disorders fourth edition (DSM-IV) classification, comprising determining whether the individual has an abnormal level of sbg1 activity in plasma, body fluids, or body tissues. The level of sbg1 or analogous compounds in plasma, body fluids, or body tissues may be determined using a variety approaches. In particular, the level may be determined using ELISA, Western Blots, or protein electrophoresis.

Biallelic Markers of the Invention in Methods of Genetic Diagnostics

The biallelic markers and other polymorphisms of the present invention can also be used to develop diagnostics tests capable of identifying individuals who express a detectable trait as the result of a specific genotype or individuals whose genotype places them at risk of developing a detectable trait at a subsequent time. The trait analyzed using the present diagnostics may be used to diagnose any detectable trait, including predisposition to schizophrenia or bipolar disorder, age of onset of detectable symptoms, a beneficial response to or side effects related to treatment against schizophrenia or bipolar disorder. Such a diagnosis can be useful in the monitoring, prognosis and/or prophylactic or curative therapy for schizophrenia or bipolar disorder.

The diagnostic techniques of the present invention may employ a variety of methodologies to determine whether a test subject has a genotype associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids.

The diagnostic techniques concern the detection of specific alleles present within the human chromosome 13q31-q33 region; optionally within the Region D subregion; and optionally within an sbg1, g34665, sbg2, g35017 or g35018 nucleic acid sequence. More particularly, the invention concerns the detection of a nucleic acid comprising at least one of the nucleotide sequences of SEQ ID Nos. 1 to 26, 36 to 40 and 54 to 229 or a fragment thereof or a complementary sequence thereto including the polymorphic base.

These methods involve obtaining a nucleic acid sample from the individual and, determining, whether the nucleic acid sample contains at least one allele or at least one biallelic marker haplotype, indicative of a risk of developing the trait or indicative that the individual expresses the trait as a result of possessing a particular the human chromosome 13q31-q33 region-related polymorphism or mutation (trait-causing allele).

Preferably, in such diagnostic methods, a nucleic acid sample is obtained from the individual and this sample is genotyped using methods described above in "Methods Of Genotyping DNA Samples For Biallelic markers." The diagnostics may be based on a single biallelic marker or a on group of biallelic markers.

In each of these methods, a nucleic acid sample is obtained from the test subject and the biallelic marker pattern of one or more of a biallelic marker of the invention is determined.

In one embodiment, a PCR amplification is conducted on the nucleic acid sample to amplify regions in which polymorphisms associated with a detectable phenotype have been identified. The amplification products are sequenced to determine whether the individual possesses one or more human chromosome 13q31-q33 region, Region D, sbg1, g34665, sbg2, g35017 or g35018-related polymorphisms associated with a detectable phenotype. The primers used to generate amplification products may comprise the primers listed in Table 6a. Alternatively, the nucleic acid sample is subjected to microsequencing reactions as described above to determine whether the individual possesses one or more human chromosome 13q31-q33 region, Region D, sbg1, g34665, sbg2, g35017 or g35018-related polymorphisms associated with a detectable phenotype resulting from a mutation or a polymorphism in the human chromosome 13q31-q33 region. The primers used in the microsequencing reactions may include the primers listed in Table 6d. In another embodiment, the nucleic acid sample is contacted with one or more allele specific oligonucleotide probes which, specifically hybridize to one or more human chromosome 13q31-q33 region, Region D, sbg1, g34665, sbg2, g35017 or g35018-related alleles associated with a detectable phenotype. The probes used in the hybridization assay may include the probes listed in 6b. In another embodiment, the nucleic acid sample is contacted with a second oligonucleotide capable of producing an amplification product when used with the allele specific oligonucleotide in an amplification reaction. The presence of an amplification product in the amplification reaction indicates that the individual possesses one or more human chromosome 13q31-q33 region, Region D, sbg1, g34665, sbg2, g35017 or g35018-related alleles associated with a detectable phenotype. In a preferred embodiment, the detectable trait is schizophrenia or bipolar disorder. Diagnostic kits comprise any of the polynucleotides of the present invention.

These diagnostic methods are extremely valuable as they can, in certain circumstances, be used to initiate preventive treatments or to allow an individual carrying a significant haplotype to foresee warning signs such as minor symptoms.

Diagnostics, which analyze and predict response to a drug or side effects to a drug, may be used to determine whether an individual should be treated with a particular drug. For example, if the diagnostic indicates a likelihood that an individual will respond positively to treatment with a particular drug, the drug may be administered to the individual. Conversely, if the diagnostic indicates that an individual is likely to respond negatively to treatment with a particular drug, an alternative course of treatment may be prescribed. A negative response may be defined as either the absence of an efficacious response or the presence of toxic side effects.

Clinical drug trials represent another application for the markers of the present invention. One or more markers indicative of response to an agent acting against schizophrenia or to side effects to an agent acting against schizophrenia may be identified using the methods described above. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems.

Prevention and Treatment of Disease Using Biallelic Markers

In large part because of the risk of suicide, the detection of susceptibility to schizophrenia, bipolar disorder as well as other psychiatric disease in individuals is very important. Consequently, the invention concerns a method for the treatment of schizophrenia or bipolar disorder, or a related disorder comprising the following steps:

selecting an individual whose DNA comprises alleles of a biallelic marker or of a group of biallelic markers of the human chromosome 13q31-q33 region, preferably Region D-related markers, and more preferably sbg1, g34665, sbg2, g35017 or g35018-related markers associated with schizophrenia or bipolar disorder;

following up said individual for the appearance (and optionally the development) of the symptoms related to schizophrenia or bipolar disorder; and administering a treatment acting against schizophrenia or bipolar disorder or against symptoms thereof to said individual at an appropriate stage of the disease.

Another embodiment of the present invention comprises a method for the treatment of schizophrenia or bipolar disorder comprising the following steps:

selecting an individual whose DNA comprises alleles of a biallelic marker or of a group of biallelic markers, of the human chromosome 13q31-q33 region, preferably Region D-related markers, and more preferably sbg1, g34665, sbg2, g35017 or g35018-related markers associated with schizophrenia or bipolar disorder;

administering a preventive treatment of schizophrenia or bipolar disorder to said individual.

In a further embodiment, the present invention concerns a method for the treatment of schizophrenia or bipolar disorder comprising the following steps:

selecting an individual whose DNA comprises alleles of a biallelic marker or of a group of biallelic markers of the human chromosome 13q31-q33, preferably Region D-related markers, and more preferably sbg1, g34665, sbg2, g35017 or g35018-related markers associated with schizophrenia or bipolar disorder;

administering a preventive treatment of schizophrenia or bipolar disorder to said individual;

following up said individual for the appearance and the development of schizophrenia or bipolar disorder symptoms; and optionally administering a treatment acting against schizophrenia or bipolar disorder or against symptoms thereof to said individual at the appropriate stage of the disease.

For use in the determination of the course of treatment of an individual suffering from disease, the present invention also concerns a method for the treatment of schizophrenia or bipolar disorder comprising the following steps:

selecting an individual suffering from schizophrenia or bipolar disorder whose DNA comprises alleles of a biallelic marker or of a group of biallelic markers of the human chromosome 13q31-q33 region, preferably Region D-related markers, and preferably sbg1, g34665, sbg2, g35017 or g35018-related markers, associated with the gravity of schizophrenia or bipolar disorder or of the symptoms thereof; and administering a treatment acting against schizophrenia or bipolar disorder or symptoms thereof to said individual.

The invention also concerns a method for the treatment of schizophrenia or bipolar disorder in a selected population of individuals. The method comprises:

selecting an individual suffering from schizophrenia or bipolar disorder and whose DNA comprises alleles of a biallelic marker or of a group of biallelic markers of the human chromosome 13q31-q33 region, preferably Region D-related markers, and more preferably sbg1, g34665, sbg2, g35017 or g35018-related markers associated with a positive response to treatment with an effective amount of a medicament acting against schizophrenia or bipolar disorder or symptoms thereof, and/or whose DNA does not comprise alleles of a biallelic marker or of a group of biallelic markers of the human chromosome 13q31-q33 region, preferably Region D-related markers, and more preferably sbg1, g34665, sbg2, g35017 or g35018-related markers associated with a negative response to treatment with said medicament; and administering at suitable intervals an effective amount of said medicament to said selected individual.

In the context of the present invention, a "positive response" to a medicament can be defined as comprising a reduction of the symptoms related to the disease. In the context of the present invention, a "negative response" to a medicament can be defined as comprising either a lack of positive response to the medicament which does not lead to a symptom reduction or which leads to a side-effect observed following administration of the medicament.

The invention also relates to a method of determining whether a subject is likely to respond positively to treatment with a medicament. The method comprises identifying a first population of individuals who respond positively to said medicament and a second population of individuals who respond negatively to said medicament. One or more biallelic markers is identified in the first population which is associated with a positive response to said medicament or one or more biallelic markers is identified in the second population which is associated with a negative response to said medicament. The biallelic markers may be identified using the techniques described herein.

A DNA sample is then obtained from the subject to be tested. The DNA sample is analyzed to determine whether it comprises alleles of one or more biallelic markers associated with a positive response to treatment with the medicament and/or alleles of one or more biallelic markers associated with a negative response to treatment with the medicament.

In some embodiments, the medicament may be administered to the subject in a clinical trial if the DNA sample contains alleles of one or more biallelic markers associated with a positive response to treatment with the medicament and/or if the DNA sample lacks alleles of one or more biallelic markers associated with a negative response to treatment with the medicament. In preferred embodiments, the medicament is a drug acting against schizophrenia or bipolar disorder.

Using the method of the present invention, the evaluation of drug efficacy may be conducted in a population of individuals likely to respond favorably to the medicament.

Another aspect of the invention is a method of using a medicament comprising obtaining a DNA sample from a subject, determining whether the DNA sample contains alleles of one or more biallelic markers associated with a positive response to the medicament and/or whether the DNA sample contains alleles of one or more biallelic markers associated with a negative response to the medicament, and administering the medicament to the subject if the DNA sample contains alleles of one or more biallelic markers associated with a positive response to the medicament and/or if the DNA sample lacks alleles of one or more biallelic markers associated with a negative response to the medicament.

The invention also concerns a method for the clinical testing of a medicament, preferably a medicament acting against schizophrenia or bipolar disorder or symptoms thereof. The method comprises the following steps:

administering a medicament, preferably a medicament susceptible of acting against schizophrenia or bipolar disorder or symptoms thereof to a heterogeneous population of individuals, identifying a first population of individuals who respond positively to said medicament and a second population of individuals who respond negatively to said medicament, identifying biallelic markers in said first population which are associated with a positive response to said medicament, selecting individuals whose DNA comprises biallelic markers associated with a positive response to said medicament, and administering said medicament to said individuals.

In any of the methods for the prevention, diagnosis and treatment of schizophrenia and bipolar disorder, including methods of using a medicament, clinical testing of a medicament, determining whether a subject is likely to respond positively to treatment with a medicament, said biallelic marker may optionally comprise:

(a) a biallelic marker selected from the group consisting of biallelic markers A1 to A489;

(b) a biallelic marker selected from the group consisting of biallelic markers A1 to A69, A71 to A74, A76 to A94, A96 to A106, A108 to A112, A114 to A177, A179 to A197, A199 to A222, A224 to A242, A250 to A251, A259, A269 to A270, A278, A285 to A295, A303 to A307, A330, A334 to A335 and A346 to 357

(c) a biallelic marker selected from the group consisting of biallelic markers A1 to A69, A71 to A74, A76 to A94, A96 to A106, A108 to A112, A114 to A177, A179 to A197, A199 to A222, A224 to A246, A250, A251, A253, A255, A259, A266, A268 to A232 and A328 to A489.

(d) a biallelic marker selected from the group consisting of sbg1-related markers A85 to A219, or more preferably a biallelic marker selected from the group consisting of sbg1-related markers A85 to A94, A96 to A106, A108 to A112, A114 to A177, A179 to A197 and A199 to A219;

(e) a biallelic marker selected from the group consisting of g34665-related markers A230 to A236;

(f) a biallelic marker selected from the group consisting of sbg2-related markers A79 to A99;

(g) the g35017-related biallelic marker A41;

(h) a biallelic marker selected from the group consisting of g35018-related markers A1 to A39;

(i) a biallelic marker selected from the group consisting of A239, A227, A198, A228, A223, A107, A218, A270, A75, A62, A65 and A70;

(j) a biallelic marker selected from the group consisting of A48, A60, A61, A62, A65, A70, A75, A76, A80, A107, A108, A198, A218, A221, A223, A227, A228, A239, A285, A286, A287, A288, A290, A292, A293, A295, A299 and A304;

(k) a biallelic marker selected from the group consisting of A304, A307, A305, A298, A292, A293, A291, A287, A286, A288, A289, A290, 99-A295 A299. A241, A239, A228, A227, A223, A221, A218, A198, A178, 99-24649/186 A108, A107, A80, A75, A70, A65, and A62; and/or (l) a biallelic marker selected from the group consisting of A304, A307, A305, A298, A292, A293, A291, A287, A286 A288, A289, A290, A295 A299, A241, A239, A228, A227, A223, A221, A218, A198, A178, A108, A107, A80, A76, A75, A70, A65, A62, A61, A60 A48.

Such methods are deemed to be extremely useful to increase the benefit/risk ratio resulting from the administration of medicaments which may cause undesirable side effects and/or be inefficacious to a portion of the patient population to which it is normally administered.

Once an individual has been diagnosed as suffering from schizophrenia or bipolar disorder, selection tests are carried out to determine whether the DNA of this individual comprises alleles of a biallelic marker or of a group of biallelic markers associated with a positive response to treatment or with a negative response to treatment which may include either side effects or unresponsiveness.

The selection of the patient to be treated using the method of the present invention can be carried out through the detection methods described above. The individuals which are to be selected are preferably those whose DNA does not comprise alleles of a biallelic marker or of a group of biallelic markers associated with a negative response to treatment. The knowledge of an individual's genetic predisposition to unresponsiveness or side effects to particular medicaments allows the clinician to direct treatment toward appropriate drugs against schizophrenia or bipolar disorder or symptoms thereof.

Once the patient's genetic predispositions have been determined, the clinician can select appropriate treatment for which negative response, particularly side effects, has not been reported or has been reported only marginally for the patient.

The biallelic markers of the invention have demonstrated an association with schizophrenia and bipolar disorders. However, the present invention also comprises any of the prevention, diagnostic, prognosis and treatment methods described herein using the biallelic markers of the invention in methods of preventing, diagnosing, managing and treating related disorders, particularly related CNS disorders. By way of example, related disorders may comprise psychotic disorders, mood disorders, autism, substance dependence and alcoholism, mental retardation, and other psychiatric diseases including cognitive, anxiety, eating, impulse-control, and personality disorders, as defined with the Diagnosis and Statistical Manual of Mental Disorders fourth edition (DSM-IV) classification".

Recombinant Vectors

The term "vector" is used herein to designate either a circular or a linear DNA or RNA molecule, which is either double-stranded or single-stranded, and which comprise at least one polynucleotide of interest that is sought to be transferred in a cell host or in a unicellular or multicellular host organism.

The present invention encompasses a family of recombinant vectors that comprise a polynucleotide derived from an sbg1, g34665, sbg2, g35017 or g35018 nucleic acid sequence. Consequently, the present invention further comprises recombinant vectors comprising:

(a) sbg1 genomic DNA or cDNAs comprised in the nucleic acids of any of nucleotide positions 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685 and 240800 to 240993 of SEQ ID No. 1, SEQ ID Nos 2 to 26 and primate sbg1 DNAs of SEQ ID Nos 54 to 111, and the complements thereof;

(b) g34665 genomic DNA or cDNAs comprised in the nucleic acids of any of nucleotide positions 292653 to 292841, 295555 to 296047 and 295580 to 296047 of SEQ ID No. 1, and the complements thereof;

(c) sbg2 genomic DNA or cDNAs comprised in the nucleic acids of any of nucleotide positions 201188 to 201234, 214676 to 214793, 215702 to 215746 and 216836 to 216915 of SEQ ID No. 1, and the complements thereof;

(d) g35017 genomic DNA or cDNAs comprised in the nucleic acids of any of nucleotide positions 94124 to 94964 of SEQ ID No. 1, and the complements thereof;

(e) g35018 genomic DNA or cDNAs comprised in the nucleic acids of any of nucleotide positions 1108 to 1289, 14877 to 14920, 18778 to 18862, 25593 to 25740, 29388 to 29502, 29967 to 30282, 64666 to 64812, and 65505 to 65853 of SEQ ID No. 1, and the complements thereof.

Generally, a recombinant vector of the invention may comprise any of the polynucleotides described herein, as well as any sbg1, g34665, sbg2, g35017 or g35018 primer or probe as defined above.

In a first preferred embodiment, a recombinant vector of the invention is used to amplify the inserted polynucleotide derived from an sbg1, g34665, sbg2, g35017 or g35018 genomic sequence or cDNA of the invention in a suitable cell host, this polynucleotide being amplified at every time that the recombinant vector replicates.

A second preferred embodiment of the recombinant vectors according to the invention comprises expression vectors comprising either a regulatory polynucleotide or a coding nucleic acid of the invention, or both. Within certain embodiments, expression vectors are employed to express an sbg1, g34665, sbg2, g35017 or g35018 polypeptide which can be then purified and, for example be used in ligand screening assays or as an immunogen in order to raise specific antibodies directed against an sbg1, g34665, sbg2, g35017 or g35018 protein. In other embodiments, the expression vectors are used for constructing transgenic animals and also for gene therapy. Expression requires that appropriate signals are provided in the vectors, said signals including various regulatory elements, such as enhancers/promoters from both viral and mammalian sources that drive expression of the genes of interest in host cells. Dominant drug selection markers for establishing permanent, stable cell clones expressing the products are generally included in the expression vectors of the invention, as they are elements that link expression of the drug selection markers to expression of the polypeptide.

More particularly, the present invention relates to expression vectors which include nucleic acids encoding an sbg1, g34665, sbg2, g35017 or g35018 protein or variants or fragments thereof, under the control of a regulatory sequence of the respective sbg1, g34665, sbg2, g35017 or g35018 regulatory polynucleotides, or alternatively under the control of an exogenous regulatory sequence.

The invention also pertains to a recombinant expression vector useful for the expression of a sbg1, g34665, sbg2, g35017 or g35018 cDNA sequence.

Recombinant vectors comprising a nucleic acid containing a human chromosome 13q31-33-related biallelic marker, preferably a Region D-related biallelic marker or more preferably an sbg1-, g34665-, sbg2-, g35017- or g35018-related biallelic marker is also part of the invention. In a preferred embodiment, said biallelic marker is selected from the group consisting of A1 to A489, and the complements thereof.

Some of the elements which can be found in the vectors of the present invention are described in further detail in the following sections.

1. General Features of the Expression Vectors of the Invention

A recombinant vector according to the invention comprises, but is not limited to, a YAC (Yeast Artificial Chromosome), a BAC (Bacterial Artificial Chromosome), a phage, a phagemid, a cosmid, a plasmid or even a linear DNA molecule which may comprise a chromosomal, non-chromosomal, semi-synthetic and synthetic DNA. Such a recombinant vector can comprise a transcriptional unit comprising an assembly of:

(1) a genetic element or elements having a regulatory role in gene expression, for example promoters or enhancers. Enhancers are cis-acting elements of DNA, usually from about 10 to 300 bp in length that act on the promoter to increase the transcription.

(2) a structural or coding sequence which is transcribed into mRNA and eventually translated into a polypeptide, said structural or coding sequence being operably linked to the regulatory elements described in (1); and (3) appropriate transcription initiation and termination sequences. Structural units intended for use in yeast or eukaryotic expression systems preferably include a leader sequence enabling extracellular secretion of translated protein by a host cell. Alternatively, when a recombinant protein is expressed without a leader or transport sequence, it may include a N-terminal residue. This residue may or may not be subsequently cleaved from the expressed recombinant protein to provide a final product.

Generally, recombinant expression vectors will include origins of replication, selectable markers permitting transformation of the host cell, and a promoter derived from a highly expressed gene to direct transcription of a downstream structural sequence. The heterologous structural sequence is assembled in appropriate phase with translation initiation and termination sequences, and preferably a leader sequence capable of directing secretion of the translated protein into the periplasmic space or the extracellular medium. In a specific embodiment wherein the vector is adapted for transfecting and expressing desired sequences in mammalian host cells, preferred vectors will comprise an origin of replication in the desired host, a suitable promoter and enhancer, and also any necessary ribosome binding sites, polyadenylation site, splice donor and acceptor sites, transcriptional termination sequences, and 5'-flanking non-transcribed sequences. DNA sequences derived from the SV40 viral genome, for example SV40 origin, early promoter, enhancer, splice and polyadenylation sites may be used to provide the required non-transcribed genetic elements.

The in vivo expression of an sbg1, g34665, sbg2, g35017 or g35018 polypeptide or fragments or variants thereof may be useful in order to correct a genetic defect related to the expression of the native gene in a host organism or to the production of a biologically inactive sbg1, g34665, sbg2, g35017 or g35018 protein.

Consequently, the present invention also comprises recombinant expression vectors mainly designed for the in vivo production of the sbg1, g34665, sbg2, g35017 or g35018 polypeptide by the introduction of the appropriate genetic material in the organism of the patient to be treated. In preferred embodiments, said genetic material comprises at least one nucleotide sequence selected from the group of nucleotide position ranges consisting of:

(a) sbg1 genomic DNA or cDNAs comprised in the nucleic acids of any of nucleotide positions 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685 and 240800 to 240993 of SEQ ID No. 1, SEQ ID Nos 2 to 26 and primate sbg1 DNAs of SEQ ID Nos. 54 to 111, and the complements thereof;

(b) g34665 genomic DNA or cDNAs comprised in the nucleic acids of any of nucleotide positions 292653 to 292841, 295555 to 296047 and 295580 to 296047 of SEQ ID No. 1, and the complements thereof;

(c) sbg2 genomic DNA or cDNAs comprised in the nucleic acids of any of nucleotide positions 201188 to 201234, 214676 to 214793, 215702 to 215746 and 216836 to 216915 of SEQ ID No. 1, and the complements thereof;

(d) g35017 genomic DNA or cDNAs comprised in the nucleic acids of any of nucleotide positions 94124 to 94964 of SEQ ID No. 1, and the complements thereof; and (e) g35018 genomic DNA or cDNAs comprised in the nucleic acids of any of nucleotide positions 1108 to 1289, 14877 to 14920, 18778 to 18862, 25593 to 25740, 29388 to 29502, 29967 to 30282, 64666 to 64812, and 65505 to 65853 of SEQ ID No. 1, and the complements thereof.

This genetic material may be introduced in vitro in a cell that has been previously extracted from the organism, the modified cell being subsequently reintroduced in the said organism, directly in vivo into the appropriate tissue.

2. Regulatory Elements

Promoters

The suitable promoter regions used in the expression vectors according to the present invention are chosen taking into account the cell host in which the heterologous gene has to be expressed. The particular promoter employed to control the expression of a nucleic acid sequence of interest is not believed to be important, so long as it is capable of directing the expression of the nucleic acid in the targeted cell. Thus, where a human cell is targeted, it is preferable to position the nucleic acid coding region adjacent to and under the control of a promoter that is capable of being expressed in a human cell, such as, for example, a human or a viral promoter.

A suitable promoter may be heterologous with respect to the nucleic acid for which it controls the expression or alternatively can be endogenous to the native polynucleotide containing the coding sequence to be expressed. Additionally, the promoter is generally heterologous with respect to the recombinant vector sequences within which the construct promoter/coding sequence has been inserted.

Promoter regions can be selected from any desired gene using, for example, CAT (chloramphenicol transferase) vectors and more preferably pKK232-8 and pCM7 vectors.

Preferred bacterial promoters are the LacI, LacZ, the T3 or T7 bacteriophage RNA polymerase promoters, the gpt, lambda PR, PL and trp promoters (EP 0036776, incorporated herein by reference), the polyhedrin promoter, or the p10 protein promoter from baculovirus (Kit Novagen) (Smith et al., 1983; O'Reilly et al., 1992, each incorporated herein by reference), the lambda PR promoter or also the trc promoter.

Eukaryotic promoters include CMV immediate early, HSV thymidine kinase, early and late SV40, LTRs from retrovirus, and mouse metallothionein-L. Selection of a convenient vector and promoter is well within the level of ordinary skill in the art.

The choice of a promoter is well within the ability of a person skilled in the field of genetic engineering. For example, one may refer to the book of Sambrook et al. (1989) or also to the procedures described by Fuller et al. (1996), incorporated herein by reference.

Other Regulatory Elements

One will typically desire to include a polyadenylation signal to effect proper polyadenylation of the gene transcript. The nature of the polyadenylation signal is not believed to be crucial to the successful practice of the invention, and any such sequence may be employed such as human growth hormone and SV40 polyadenylation signals. Also contemplated as an element of the expression cassette is a terminator. These elements can serve to enhance message levels and to minimize read through from the cassette into other sequences.

The vector containing the appropriate DNA sequence as described above, more preferably an sbg1 gene regulatory polynucleotide, a polynucleotide encoding an sbg1, g34665, sbg2, g35017 or g35018 polypeptide comprising at least one nucleotide sequence selected from the group of nucleotide sequence ranges consisting of:

(a) sbg1 genomic DNA or cDNAs comprised in the nucleic acids of any of nucleotide positions 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685 and 240800 to 240993 of SEQ ID No. 1, SEQ ID Nos 2 to 26 and primate sbg1 DNAs or SEQ ID Nos. 54 to 111, and the complements thereof;

(b) g34665 genomic DNA or cDNAs comprised in the nucleic acids of any of nucleotide positions 292653 to 292841, 295555 to 296047 and 295580 to 296047 of SEQ ID No. 1, and the complements thereof;

(c) sbg2 genomic DNA or cDNAs comprised in the nucleic acids of any of nucleotide positions 201188 to 201234, 214676 to 214793, 215702 to 215746 and 216836 to 216915 of SEQ ID No. 1, and the complements thereof;

(d) g35017 genomic DNA or cDNAs comprised in the nucleic acids of any of nucleotide positions 94124 to 94964 of SEQ ID No. 1, and the complements thereof;

(e) g35018 genomic DNA or cDNAs comprised in the nucleic acids of any of nucleotide positions 1108 to 1289, 14877 to 14920, 18778 to 18862, 25593 to 25740, 29388 to 29502, 29967 to 30282, 64666 to 64812, and 65505 to 65853 of SEQ ID No. 1, and the complements thereof.

3. Selectable Markers

Such markers would confer an identifiable change to the cell permitting easy identification of cells containing the expression construct. The selectable marker genes for selection of transformed host cells are preferably dihydrofolate reductase or neomycin resistance for eukaryotic cell culture, TRP1 for *S. cerevisiae* or tetracycline, rifampicin or ampicillin resistance in *E. coli*, or levan saccharase for mycobacteria, this latter marker being a negative selection marker.

4. Preferred Vectors.

Bacterial Vectors

As a representative but non-limiting example, useful expression vectors for bacterial use can comprise a selectable marker and a bacterial origin of replication derived from commercially available plasmids comprising genetic elements of pBR322 (ATCC 37017). Such commercial vectors include, for example, pKK223-3 (Pharmacia, Uppsala, Sweden), and GEM1 (Promega Biotec, Madison, Wis., USA).

Large numbers of other suitable vectors are known to those of skill in the art, and commercially available, such as the following bacterial vectors: pQE70, pQE60, pQE-9 (Qiagen), pbs, pD10, phagescript, psiX174, pbluescript SK, pbsks, pNH8A, pNH16A, pNH18A, pNH46A (Stratagene); ptrc99a, pKK223-3, pKK233-3, pDR540, pRIT5 (Pharmacia); pWLNEO, pSV2CAT, pOG44, pXT1, pSG (Stratagene); pSVK3, pBPV, pMSG, pSVL (Pharmacia); pQE-30 (QIAexpress).

Bacteriophage Vectors

The P1 bacteriophage vector may contain large inserts ranging from about 80 to about 100 kb.

The construction of P1 bacteriophage vectors such as p158 or p158/neo8 are notably described by Sternberg (1992, 1994), each incorporated herein by reference. Recombinant P1 clones comprising sbg1 polynucleotide sequences may be designed for inserting large polynucleotides of more than 40 kb (Linton et al., 1993, incorporated herein by reference). To generate P1 DNA for transgenic experiments, a preferred protocol is the protocol described by McCormick et al. (1994), incorporated herein by reference. Briefly, *E. coli* (preferably strain NS3529) harboring the P1 plasmid are grown overnight in a suitable broth medium containing 25 µg/ml of kanamycin. The P1 DNA is prepared from the *E. coli* by alkaline lysis using the Qiagen Plasmid Maxi kit (Qiagen, Chatsworth, Calif., USA), according to the manufacturer's instructions. The P1 DNA is purified from the bacterial lysate on two Qiagen-tip 500 columns, using the washing and elution buffers contained in the kit. A phenol/chloroform extraction is then performed before precipitating the DNA with 70% ethanol. After solubilizing the DNA in TE (10 mM Tris-HCl, pH 7.4, 1 mM EDTA), the concentration of the DNA is assessed by spectrophotometry.

When the goal is to express a P1 clone comprising an sbg1 polynucleotide sequence in a transgenic animal, typically in transgenic mice, it is desirable to remove vector sequences from the P1 DNA fragment, for example by cleaving the P1 DNA at rare-cutting sites within the P1 polylinker (SfiI, NotI or SalI). The P1 insert is then purified from vector sequences on a pulsed-field agarose gel, using methods similar using methods similar to those originally reported for the isolation of DNA from YACs (Schedl et al., 1993a; Peterson et al., 1993, each incorporated herein by reference). At this stage, the resulting purified insert DNA can be concentrated, if necessary, on a Millipore Ultrafree-MC Filter Unit (Millipore, Bedford, Mass., USA—30,000 molecular weight limit) and then dialyzed against microinjection buffer (10 mM Tris-HCl, pH 7.4; 250 µM EDTA) containing 100 mM NaCl, 30 µM spermine, 70 µM sperm idine on a microdyalisis membrane (type VS, 0.025 µM from Millipore). The intactness of the purified P1 DNA insert is assessed by electrophoresis on 1% agarose (Sea Kem GTG; FMC Bioproducts) pulse-field gel and staining with ethidium bromide.

Baculovirus Vectors

A suitable vector for the expression of an sbg1 polypeptide encoded by polynucleotides of SEQ ID No. 1 or fragments or variants thereof is a baculovirus vector that can be propagated in insect cells and in insect cell lines. A specific suitable host vector system is the pVL1392/1393 baculovirus transfer vector (Pharmingen) that is used to transfect the SF9 cell line (ATCC N°CRL 1711) which is derived from *Spodoptera frugiperda*.

Other suitable vectors for the expression of the sbg1 polypeptide encoded by the SEQ ID No. 1 or fragments or variants thereof in a baculovirus expression system include those described by Chai et al. (1993), Vlasak et al. (1983) and Lenhard et al. (1996), the disclosures of each of which are incorporated herein by reference.

Viral Vectors

In one specific embodiment, the vector is derived from an adenovirus. Preferred adenovirus vectors according to the invention are those described by Feldman and Steg (1996) or Ohno et al. (1994), the disclosures of each of which are incorporated herein by reference. Another preferred recombinant adenovirus according to this specific embodiment of the present invention is the human adenovirus type 2 or 5 (Ad 2 or Ad 5) or an adenovirus of animal origin (French patent application N° FR-93.05954, incorporated herein by reference).

Retrovirus vectors and adeno-associated virus vectors are generally understood to be the recombinant gene delivery systems of choice for the transfer of exogenous polynucleotides in vivo, particularly to mammals, including humans. These vectors provide efficient delivery of genes into cells, and the transferred nucleic acids are stably integrated into the chromosomal DNA of the host.

Particularly preferred retroviruses for the preparation or construction of retroviral in vitro or in vitro gene delivery vehicles of the present invention include retroviruses selected from the group consisting of Mink-Cell Focus Inducing Virus, Murine Sarcoma Virus, Reticuloendotheliosis virus and Rous Sarcoma virus. Particularly preferred Murine Leukemia Viruses include the 4070A and the 1504A viruses, Abelson (ATCC No VR-999), Friend (ATCC No VR-245), Gross (ATCC No VR-590), Rauscher (ATCC No VR-998) and Moloney Murine Leukemia Virus (ATCC No VR-190; PCT Application No WO 94/24298). Particularly preferred Rous Sarcoma Viruses include Bryan high titer (ATCC Nos VR-334, VR-657, VR-726, VR-659 and VR-728). Other preferred retroviral vectors are those described in Roth et al. (1996), PCT Application No WO 93/25234, PCT Application No WO 94/06920, Roux et al., 1989, Julan et al., 1992 and Neda et al., 1991. Each of the above disclosures are incorporated herein by reference.

Yet another viral vector system that is contemplated by the invention comprises the adeno-associated virus (AAV). The adeno-associated virus is a naturally occurring defective virus that requires another virus, such as an adenovirus or a herpes virus, as a helper virus for efficient replication and a productive life cycle (Muzyczka et al., 1992, incorporated herein by reference). It is also one of the few viruses that may integrate its DNA into non-dividing cells, and exhibits a high frequency of stable integration (Flotte et al., 1992; Samulski et al., 1989; McLaughlin et al., 1989, the disclosures of which are incorporated herein by reference). One advantageous feature of AAV derives from its reduced efficacy for transducing primary cells relative to transformed cells.

BAC Vectors

The bacterial artificial chromosome (BAC) cloning system (Shizuya et al., 1992, incorporated herein by reference) has been developed to stably maintain large fragments of genomic DNA (100–300 kb) in *E. coli*. A preferred BAC vector comprises pBeloBAC11 vector that has been described by Kim et al. (1996), incorporated herein by reference. BAC libraries are prepared with this vector using size-selected genomic DNA that has been partially digested using enzymes that permit ligation into either the BamHI or HindIII sites in the vector. Flanking these cloning sites are T7 and SP6 RNA polymerase transcription initiation sites that can be used to generate end probes by either RNA transcription or PCR methods. After the construction of a BAC library in *E. coli*, BAC DNA is purified from the host cell as a supercoiled circle. Converting these circular molecules into a linear form precedes both size determination and introduction of the BACs into recipient cells. The cloning site is flanked by two NotI sites, permitting cloned segments to be excised from the vector by NotI digestion. Alternatively, the DNA insert contained in the pBeloBAC11 vector may be linearized by treatment of the BAC vector with the commercially available enzyme lambda terminase that leads to the cleavage at the unique cosN site, but this cleavage method results in a full length BAC clone containing both the insert DNA and the BAC sequences.

5. Delivery of the Recombinant Vectors

In order to effect expression of the polynucleotides and polynucleotide constructs of the invention, these constructs must be delivered into a cell. This delivery may be accomplished in vitro, as in laboratory procedures for transforming cell lines, or in vivo or ex vivo, as in the treatment of certain diseases states.

One mechanism is viral infection where the expression construct is encapsulated in an infectious viral particle.

Several non-viral methods for the transfer of polynucleotides into cultured mammalian cells are also contemplated by the present invention, and include, without being limited to, calcium phosphate precipitation (Graham et al., 1973; Chen et al., 1987), DEAE-dextran (Gopal, 1985), electroporation (Tur-Kaspa et al., 1986; Potter et al., 1984), direct microinjection (Harland et al., 1985), DNA-loaded liposomes (Nicolau et al., 1982; Fraley et al., 1979), and receptor-mediated transfection (Wu and Wu, 1987; 1988). Some of these techniques may be successfully adapted for in vivo or ex vivo use. The disclosures of each of these publications are incorporated herein by reference.

Once the expression polynucleotide has been delivered into the cell, it may be stably integrated into the genome of the recipient cell. This integration may be in the cognate location and orientation via homologous recombination (gene replacement) or it may be integrated in a random, non specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle.

One specific embodiment for a method for delivering a protein or peptide to the interior of a cell of a vertebrate in vivo comprises the step of introducing a preparation comprising a physiologically acceptable carrier and a naked polynucleotide operatively coding for the polypeptide of interest into the interstitial space of a tissue comprising the cell, whereby the naked polynucleotide is taken up into the interior of the cell and has a physiological effect. This is particularly applicable for transfer in vitro but it may be applied to in vivo as well.

Compositions for use in vitro and in vivo comprising a "naked" polynucleotide are described in PCT application N°

WO 90/11092 (Vical Inc.) and also in PCT application No. WO 95/11307 (Institut Pasteur, INSERM, Université d'Ottawa) as well as in the articles of Tacson et al. (1996) and of Huygen et al. (1996), the disclosures of which are all incorporated herein by reference.

In still another embodiment of the invention, the transfer of a naked polynucleotide of the invention, including a polynucleotide construct of the invention, into cells may be proceeded with a particle bombardment (biolistic), said particles being DNA-coated microprojectiles accelerated to a high velocity allowing them to pierce cell membranes and enter cells without killing them, such as described by Klein et al. (1987), incorporated herein by reference.

In a further embodiment, the polynucleotide of the invention may be entrapped in a liposome (Ghosh and Bacchawat, 1991; Wong et al., 1980; Nicolau et al., 1987) the disclosures of which are incorporated herein by reference.

In a specific embodiment, the invention provides a composition for the in vivo production of the sbg1, g34665, sbg2, g35017 and g35018 protein or polypeptide described herein. It comprises a naked polynucleotide operatively coding for this polypeptide, in solution in a physiologically acceptable carrier, and suitable for introduction into a tissue to cause cells of the tissue to express the said protein or polypeptide.

The amount of vector to be injected to the desired host organism varies according to the site of injection. As an indicative dose, it will be injected between 0.1 and 100 µg of the vector in an animal body, preferably a mammal body, for example a mouse body.

In another embodiment of the vector according to the invention, it may be introduced in vitro in a host cell, preferably in a host cell previously harvested from the animal to be treated and more preferably a somatic cell such as a muscle cell. In a subsequent step, the cell that has been transformed with the vector coding for the desired sbg1 polypeptide or the desired fragment thereof is reintroduced into the animal body in order to deliver the recombinant protein within the body either locally or systemically.

Cell Hosts

Another object of the invention comprises a host cell that have been transformed or transfected with one of the polynucleotides described herein, and more precisely a polynucleotide comprising an sbg1 polynucleotide selected from the group consisting of SEQ ID Nos. 1 to 26, 36 to 40 and 54 to 229, or a fragment or a variant thereof. Are included host cells that are transformed (prokaryotic cells) or that are transfected (eukaryotic cells) with a recombinant vector such as one of those described above.

Generally, a recombinant host cell of the invention comprises any one of the polynucleotides or the recombinant vectors described therein.

Preferred host cells used as recipients for the expression vectors of the invention are the following:

a) Prokaryotic host cells: *Escherichia coli* strains (I.E.DH5-α strain), *Bacillus subtilis, Salmonella typhimurium*, and strains from species like *Pseudomonas, Streptomyces* and *Staphylococcus*.

b) Eukaryotic host cells: HeLa cells (ATCC N°CCL2; N°CCL2.1; N°CCL2.2), Cv 1 cells (ATCC N°CCL70), COS cells (ATCC N°CRL1650; N°CRL1651), Sf-9 cells (ATCC N°CRL1711), C127 cells (ATCC N° CRL-1804), 3T3 (ATCC N° CRL-6361), CHO (ATCC N° CCL-61), human kidney 293. (ATCC N° 45504; N° CRL-1573) and BHK (ECACC N° 84100501; N° 84111301).

c) Other mammalian host cells.

Sbg1, g34665, sbg2, g35017 and g35018 gene expression in mammalian, and typically human, cells may be rendered defective with the replacement of an sbg1 nucleic acid counterpart in the genome of an animal cell by an sbg1 polynucleotide according to the invention. These genetic alterations may be generated by homologous recombination events using specific DNA constructs that have been previously described.

One kind of cell hosts that may be used are mammal zygotes, such as murine zygotes. For example, murine zygotes may undergo microinjection with a purified DNA molecule of interest, for example a purified DNA molecule that has previously been adjusted to a concentration range from 1 ng/ml—for BAC inserts—3 ng/µl—for P1 bacteriophage inserts—in 10 mM Tris-HCl, pH 7.4, 250 µM EDTA containing 100 mM NaCl, 30 µM spermine, and 70 µM spermidine. When the DNA to be microinjected has a large size, polyamines and high salt concentrations can be used in order to avoid mechanical breakage of this DNA, as described by Schedl et al (1993b), the disclosure of which is all incorporated herein by reference.

Any of the polynucleotides of the invention, including the DNA constructs described herein, may be introduced in an embryonic stem (ES) cell line, preferably a mouse ES cell line. ES cell lines are derived from pluripotent, uncommitted cells of the inner cell mass of pre-implantation blastocysts. Preferred ES cell lines are the following: ES-E14TG2a (ATCC n° CRL-1821), ES-D3 (ATCC n° CRL1934 and n° CRL-11632), YS001 (ATCC n° CRL-11776), 36.5 (ATCC n° CRL-11116). To maintain ES cells in an uncommitted state, they are cultured in the presence of growth inhibited feeder cells which provide the appropriate signals to preserve this embryonic phenotype and serve as a matrix for ES cell adherence. Preferred feeder cells are primary embryonic fibroblasts that are established from tissue of day 13-day 14 embryos of virtually any mouse strain, that are maintained in culture, such as described by Abbondanzo et al. (1993) and are inhibited in growth by irradiation, such as described by Robertson (1987), or by the presence of an inhibitory concentration of LIF, such as described by Pease and Williams (1990), the disclosures of which are incorporated herein by reference.

The constructs in the host cells can be used in a conventional manner to produce the gene product encoded by the recombinant sequence.

Following transformation of a suitable host and growth of the host to an appropriate cell density, the selected promoter is induced by appropriate means, such as temperature shift or chemical induction, and cells are cultivated for an additional period.

Cells are typically harvested by centrifugation, disrupted by physical or chemical means, and the resulting crude extract retained for further purification.

Microbial cells employed in the expression of proteins can be disrupted by any convenient method, including freeze-thaw cycling, sonication, mechanical disruption, or use of cell lysing agents. Such methods are well known by the skill artisan.

Transgenic Animals

The terms "transgenic animals" or "host animals" are used herein designate animals that have their genome genetically and artificially manipulated so as to include one of the nucleic acids according to the invention. Preferred animals are non-human mammals and include those belonging to a genus selected from *Mus* (e.g. mice), *Rattus* (e.g. rats) and *Oryctogalus* (e.g. rabbits) which have their genome artificially and genetically altered by the insertion of a nucleic acid according to the invention. In one embodiment, the invention encompasses non-human host mammals and animals comprising a recombinant vector of the invention or an sbg1, g34665, sbg2, g35017 or g35018 gene disrupted by homologous recombination with a knock out vector. The invention also encompasses non-human primates comprising a recombinant vector of the invention or an sbg1, g34665, sbg2, g35017 or g35018 gene disrupted by homologous recombination with a knock out vector.

The transgenic animals of the invention all include within a plurality of their cells a cloned recombinant or synthetic DNA sequence, more specifically one of the purified or isolated nucleic acids comprising an sbg1, g34665, sbg2, g35017 or g35018 polynucleotide or a DNA sequence encoding an antisense polynucleotide such as described in the present specification.

Generally, a transgenic animal according the present invention comprises any one of the polynucleotides, the recombinant vectors and the cell hosts described in the present invention.

In a first preferred embodiment, these transgenic animals may be good experimental models in order to study the diverse pathologies related to cell differentiation, in particular concerning the transgenic animals within the genome of which has been inserted one or several copies of a polynucleotide encoding a native sbg1, g34665, sbg2, g35017 or g35018 protein, or alternatively a mutant sbg1, g34665, sbg2, g35017 or g35018 protein.

In a second preferred embodiment, these transgenic animals may express a desired polypeptide of interest under the control of regulatory polynucleotides which lead to good yields in the synthesis of this protein of interest, and optionally a tissue specific expression of this protein of interest.

The design of the transgenic animals of the invention may be made according to the conventional techniques well known from the one skilled in the art. For more details regarding the production of transgenic animals, and specifically transgenic mice, it may be referred to U.S. Pat. No. 4,873,191, issued Oct. 10, 1989; U.S. Pat. No. 5,464,764 issued Nov. 7, 1995; and U.S. Pat. No. 5,789,215, issued Aug. 4, 1998; these documents being herein incorporated by reference to disclose methods producing transgenic mice.

Transgenic animals of the present invention are produced by the application of procedures which result in an animal with a genome that has incorporated exogenous genetic material. The procedure involves obtaining the genetic material, or a portion thereof, which encodes either an sbg1, g34665, sbg2, g35017 or g35018 polynucleotide or antisense polynucleotide such as described in the present specification.

A recombinant polynucleotide of the invention is inserted into an embryonic or ES stem cell line. The insertion is preferably made using electroporation, such as described by Thomas et al. (1987), the disclosure of which is incorporated herein by reference. The cells subjected to electroporation are screened (e.g. by selection via selectable markers, by PCR or by Southern blot analysis) to find positive cells which have integrated the exogenous recombinant polynucleotide into their genome, preferably via an homologous recombination event. An illustrative positive-negative selection procedure that may be used according to the invention is described by Mansour et al. (1988), incorporated herein by reference.

Then, the positive cells are isolated, cloned and injected into 3.5 days old blastocysts from mice, such as described by Bradley (1987), incorporated herein by reference. The blastocysts are then inserted into a female host animal and allowed to grow to term.

Alternatively, the positive ES cells are brought into contact with embryos at the 2.5 days old 8–16 cell stage (morulae) such as described by Wood et al. (1993) or by Nagy et al. (1993), the disclosures of which are incorporated herein by reference, the ES cells being internalized to colonize extensively the blastocyst including the cells which will give rise to the germ line.

The offspring of the female host are tested to determine which animals are transgenic e.g. include the inserted exogenous DNA sequence and which are wild-type.

Thus, the present invention also concerns a transgenic animal containing a nucleic acid, a recombinant expression vector or a recombinant host cell according to the invention.

Recombinant Cell Lines Derived from the Transgenic Animals of the Invention

A further object of the invention comprises recombinant host cells obtained from a transgenic animal described herein. In one embodiment the invention encompasses cells derived from non-human host mammals and animals comprising a recombinant vector of the invention or a gene comprising an sbg1, g34665, sbg2, g35017 or g35018 nucleic acid sequence disrupted by homologous recombination with a knock out vector.

Recombinant cell lines may be established in vitro from cells obtained from any tissue of a transgenic animal according to the invention, for example by transfection of primary cell cultures with vectors expressing onc-genes such as SV40 large T antigen, as described by Chou (1989) and Shay et al. (1991), the disclosures of which are incorporated herein by reference.

Assays for Identification of Compounds for Treatment of Schizophrenia and Bipolar Disorder The present invention provides assays which may be used to test compounds for their ability to treat CNS disorders, and in particular, to ameliorate symptoms of a CNS disorder mediated by sbg1, g34665, sbg2, g35017 or g35018. In preferred embodiments, compounds tested for their ability to ameliorate syptoms of schizophrenia or bipolar disorder mediated by sbg1, g34665, sbg2, g35017 or g35018. Compounds may also be tested for their ability to treat related disorders, including among others psychotic disorders, mood disorders, autism, substance dependence and alcoholism, mental retardation, and other psychiatric diseases including cognitive, anxiety, eating, impulse-control, and personality disorders, as defined with the Diagnosis and Statistical Manual of Mental Disorders fourth edition (DSM-IV) classification.

The present invention also provides cell and animal, including primate and mouse, models of schizophrenia, bipolar disorder and related disorders.

In one aspect, provided are non-cell based, cell based and animal based assays for the identification of such compounds that affect sbg1 activity. Sbg1 activity may be affected by any mechanism; in certain embodiments, sbg1 activity is affected by modulating sbg1 gene expression or the activity of the sbg1 gene product.

The present methods allow the identification of compounds that affect sbg1 activity directly or indirectly. Thus, the non-cell based, cell based and animal assays of the present invention may also be used to identify compounds that act on an element of a sbg1 pathway other than sbg1 itself. These compounds can then be used as a therapeutic treatment to modulate sbg1 and other gene products involved in schizophrenia, bipolar disorder and related disorders.

Cell and Non-cell Based Assays

In one aspect, cell based assays using recombinant or non-recombinant cells may be used to identify compounds which modulate sbg1 activity.

In one aspect, a cell based assay of the invention encompasses a method for identifying a test compound for the treatment of schizophrenia or bipolar disorder comprising (a) exposing a cell to a test compound at a concentration and time sufficient to ameliorate an endpoint related to schizophrenia or bipolar disorder, and (b) determining the level of sbg1 activity in a cell. Sbg1 activity can be measured, for example, by assaying a cell for mRNA transcript level, sbg1peptide expression, localization or protein activity. Preferably the test compound is a compound capable of or suspected to be capable of ameliorating a symptom of schizophrenia, bipolar disorder or a related disorder. Test compounds capable of modulating sbg1 activity may be selected for use in developing medicaments. Such cell based assays are further described herein in the section titled "Method For Screening Ligands That Modulate The Expression Of The sbg1, g34665, sbg2, g35017 and g35018 Gene."

In another aspect, a cell based assay of the invention encompasses a method for identifying a compound for the treatment of schizophrenia or bipolar disorder comprising (a) exposing a cell to a level of sbg1 activity sufficient to cause a schizophrenia-related or bipolar disorder-related endpoint, and (b) exposing said cell to a test compound. A test compound can then be selected according to its ability to ameliorate said schizophrenia-related or bipolar disorder-related endpoints. sbg1 activity may be provided by any suitable method, including but not limited to providing a vector containing an sbg1 nucleotide sequence, treating said cell with a compound capable of increasing sbg1 expression and treating said cell with an sbg1 peptide. Preferably said cell is treated with an sbg1 peptide comprising a contiguous span of at least 4 amino acids of SEQ ID Nos. 27 to 35; most preferably said sbg1 peptide comprises amino acid positions 124 to 153 of SEQ ID No 34, as described in Example 7. Preferably the test compound is a compound capable of or suspected to be capable of ameliorating a symtpom of schizophrenia, bipolar disorder or a related disorder; alternatively, the test compound is suspected of exacerbating an endpoint schizophrenia, bipolar disorder or a related disorder. A test compound capable of ameliorating any detectable symptom or endpoint of a schizophrenia, bipolar disorder or a related disorder may be selected for use in developing medicaments.

In another embodiment, the invention provides cell and non-cell based assays to sbg1 to determine whether sbg peptides bind to the cell surface, and to identify compounds for the treatment of schizophrenia, bipolar disorder and related disorders that interact with an sbg1 receptor. In one such embodiment, an sbg1 polynucleotide, or fragments thereof, is cloned into expression vectors such as those described herein. The proteins are purified by size, charge, immunochromatography or other techniques familiar to those skilled in the art. Following purification, the proteins are labeled using techniques known to those skilled in the art. The labeled proteins are incubated with cells or cell lines derived from a variety of organs or tissues to allow the proteins to bind to any receptor present on the cell surface. Following the incubation, the cells are washed to remove non-specifically bound protein. The labeled proteins are detected by autoradiography. Alternatively, unlabeled proteins may be incubated with the cells and detected with antibodies having a detectable label, such as a fluorescent molecule, attached thereto. Specificity of cell surface binding may be analyzed by conducting a competition analysis in which various amounts of unlabeled protein are incubated along with the labeled protein. The amount of labeled protein bound to the cell surface decreases as the amount of competitive unlabeled protein increases. As a control, various amounts of an unlabeled protein unrelated to the labeled protein is included in some binding reactions. The amount of labeled protein bound to the cell surface does not decrease in binding reactions containing increasing amounts of unrelated unlabeled protein, indicating that the protein encoded by the nucleic acid binds specifically to the cell surface.

In another embodiment, the present invention comprises non-cell based binding assays, wherein an sbg1 polypeptide is prepared and purified as in cell based binding assays described above. Following purification, the proteins are labeled and incubated with a cell membrane extract or isolate derived from any desired cells from any organs, tissue or combination of organs or tissues of interest to allow the sbg1 polypeptide to bind to any receptor present on a membrane. Following the incubation, the membranes are washed to remove non-specifically bound protein. The labeled proteins may be detected by autoradiography. Specificity of membrane binding of sbg1 may be analyzed by conducting a competition analysis in which various amounts of a test compound are incubated along with the labeled protein. Any desired test compound, including test polypeptides, can be incubated with the cells. The test compounds may be detected with antibodies having a detectable label, such as a fluorescent molecule, attached thereto. The amount of labeled sbg1 polypeptide bound to the cell surface decreases as the amount of competitive test compound increases. As a control, various amounts of an unlabeled protein or a compound unrelated to the test compound is included in some binding reactions. Test compounds capable of reducing the amount of sbg1 bound to cell membranes may be selected as a candidate therapeutic compound.

In preferred embodiments of the cell and non-cell based assays, said sbg1 peptide comprising a contiguous span of at least 4 amino acids of SEQ ID Nos. 27 to 35; most preferably said sbg1 peptide comprises amino acid positions 124 to 153 of SEQ ID No 34.

Said cell based assays may comprise cells of any suitable origin; particularly preferred cells are human cells, primate cells, non-human primate cells and mouse cells. If non-human primate cells are used, the sbg1 may comprise a nucleotide sequence or be encoded by a nucleotide sequence according to the primate nucleic acid sequences of SEQ ID No. 54 to 111, or a sequence complementary thereto or a fragment thereof.

Animal Model Based Assay

Non-human animal-based assays may also be used to identify compounds which modulate sbg1 activity. The invention encompasses animal models and animal-based assays suitable, including non-transgenic or transgenic animals, including animals containing a human or altered form of the sbg1 gene.

Thus, the present invention comprises treating an animal affected by schizophrenia or bipolar disorder or symptoms thereof with a test compound capable of directly or indirectly modulating sbg1 activity.

In one aspect, an animal-based assay of the invention encompasses a method for identifying a test compound for the treatment of schizophrenia or bipolar disorder comprising (a) exposing an animal to a test compound at a concentration and time sufficient to ameliorate an endpoint related to schizophrenia or bipolar disorder, and (b) determining the level of sbg1 activity at a site in said animal. Activity of sbg1 can be measured in any suitable cell, tissue or site. Preferably the test compound is a compound capable of or suspected to be capable of ameliorating a symptom of schizophrenia, bipolar disorder or a related disorder. Optionally said test compound is capable or suspected to be capable of modulating sbg1 activity. Test compounds capable of modulating sbg1 activity may be selected for use in developing medicaments.

In another aspect, an animal-based assay of the invention encompasses a method for identifying a compound for the treatment of schizophrenia or bipolar disorder comprising (a) exposing an animal to a level of sbg1 activity sufficient to cause a schizophrenia-related or bipolar disorder-related symptom or endpoint, and (b) exposing said animal to a test compound. A test compound can then be selected according to its ability to ameliorate said schizophrenia-related or bipolar disorder-related endpoints. Activity of sbg1 may be provided by any suitable method, including but not limited to providing a vector containing an sbg1 nucleotide sequence, treating said animal with a compound capable of increasing sbg1 expression and treating said cell with an sbg1 peptide. Preferably, said animal is treated with an sbg1 peptide comprising a contiguous span of at least 4 amino acids of SEQ ID Nos. 27 to 35; most preferably said sbg1 peptide comprises amino acid positions 124 to 153 of SEQ ID No 34, as described in Example 7. Preferably the test compound is a compound capable of or suspected to be capable of ameliorating a symptom of schizophrenia, bipolar disorder or a related disorder; alternatively, the test compound is suspected of exacerbating a symptom of schizophrenia, bipolar disorder or a related disorder. A test compound capable of ameliorating any detectable symptom or endpoint of a schizophrenia, bipolar disorder or a related disorder may be selected for use in developing medicaments.

Any suitable animal may be used. Preferably, said animal is a primate, a non-human primate, a mammal, or a mouse.

In one embodiment, a mouse is treated with an sbg1 peptide, exposed to a test compound, and symptoms indicative of schizophrenia, bipolar disorder or a related disorder are assessed by observing stereotypy. In other embodiments, said symptoms are assessed by performing at least one test from the group consisting of home cage observation, neurological evaluation, stress-induced hypothermia, forced swim, PTZ seizure, locomotor activity, tail suspension, elevated plus maze, novel object recognition, prepulse inhibition, thermal pain, Y-maze, and metabolic chamber tests (Psychoscreen™ tests available from Psychogenics Inc.). Other tests are known in Crawley et al, Horm. Behav. 31(3):197–211 (1997); Crawley, Brain Res 835(1):18–26 (1999) for example.

Figure 18:
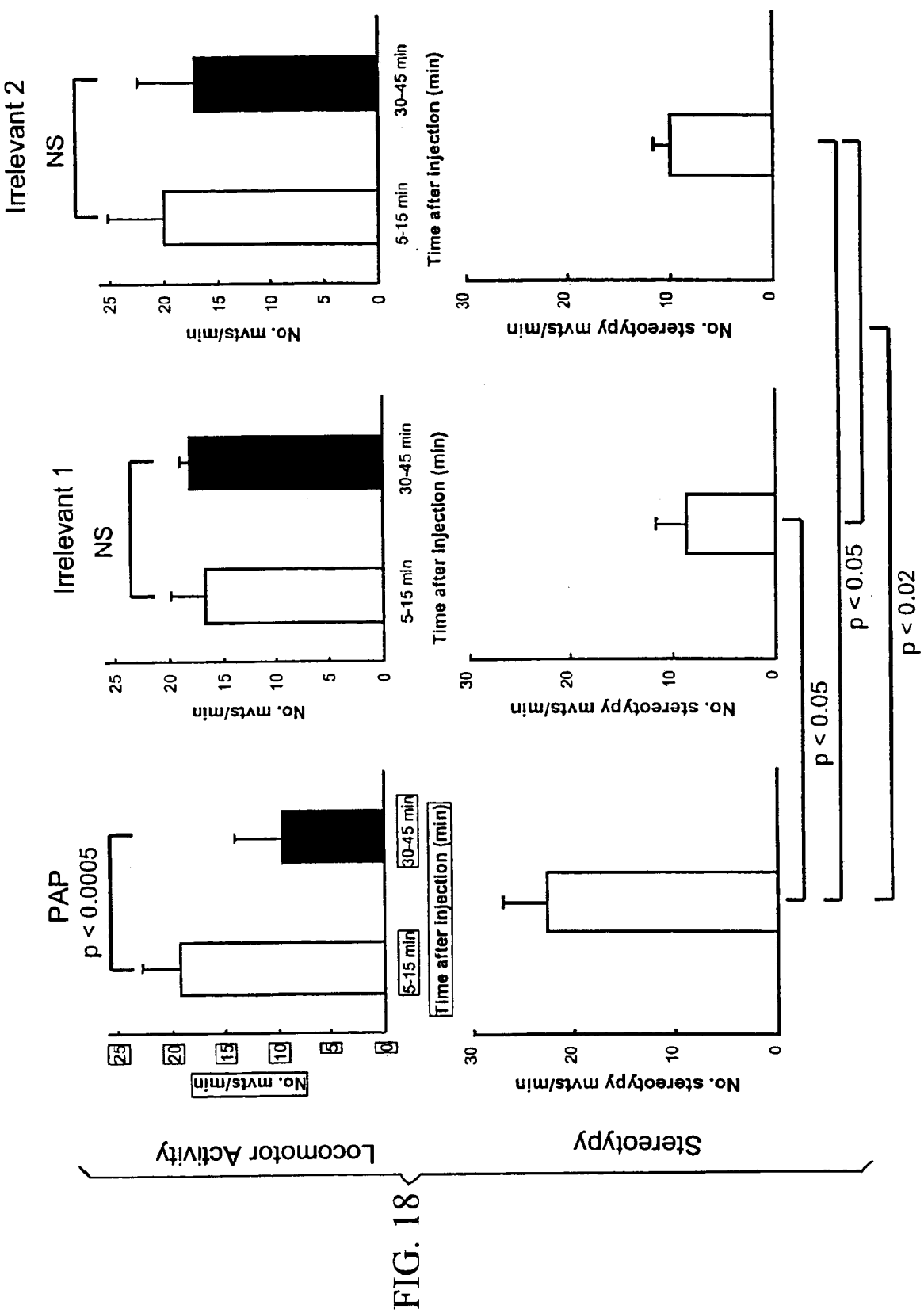
FIG. 18 shows the effect of injection of an sbg1 peptide on locomotor activity and stereotypy of mice.

In one example, the present inventors have tested sbg1 peptides by injection into mice. An sbg1 peptide comprising amino acid positions 124 to 153 of SEQ ID No 34 was injected peritoneally into adult mice as described herein in Example 7. Upon observation, mice injected with the sbg1 peptide exhibited a decrease in the frequency of their movements over the time course of the experiment. FIG. 18 demonstrates (left top panel of the figure) a comparison of the average number of movements in 3 separate time points (5, 10, and 15 min) with the average movements per min in the last period of observations (30, 35, 40, and 45 min). The sbg1 peptide also increased stereotypy—this effect was most prominent during the last period of observations. Because the onset of stereotypy was variable, data are presented as the average of stereotypy for observations over the entire time period.

The present inventors have also determined that the sbg1 gene exists in several non-human primates. In a preferred embodiment of the animal models and drug screening assays of the invention, a non-human primate is treated with an sbg1 peptide and exposed to a test compound, wherein said sbg1 peptide is encoded by a nucleotide sequence according to the primate nucleic acid sequences of SEQ ID No. 54 to 111, or a sequence complementary thereto or a fragment thereof.

Any suitable test compound may be used with the screening methods of the invention. Examples of compounds that may be screened by the methods of the present invention include small organic or inorganic molecules, nucleic acids, including polynucleotides from random and directed polynucleotide libraries, peptides, including peptides derived from random and directed peptide libraries, soluble peptides, fusion peptides, and phosphopeptides, antibodies including polyclonal, monoclonal, chimeric, humanized, and anti-idiotypic antibodies, and single chain antibodies, FAb, F(ab')$_2$ and FAb expression library fragments, and epitope-binding fragments thereof. In certain aspects, a compound capable of ameliorating or exacerbating a symptom or endpoint of schizophrenia, bipolar disorder or a related disorder may include, by way of example, antipsychotic drugs in general, neuroleptics, atypical neuroleptics, antidepressants, anti-anxiety drugs, noradrenergic agonists and antagonists, dopaminergic agonists and antagonists, serotonin reuptake inhibitors, benzodiazepines.

Methods for Screening Substances Interacting with an sbg1, g34665, sbg2, g35017 or g35018 Polypeptides For the purpose of the present invention, a ligand means a molecule, such as a protein, a peptide, an antibody or any synthetic chemical compound capable of binding to the sbg1, g34665, sbg2, g35017 or g35018 protein or one of its fragments or variants orto modulate the expression of the polynucleotide coding for the sbg1, g34665, sbg2, g35017 or g35018 or a fragment or variant thereof.

In the ligand screening method according to the present invention, a biological sample or a defined molecule to be tested as a putative ligand of the sbg1, g34665, sbg2, g35017 or g35018 protein is brought into contact with the corresponding purified sbg1, g34665, sbg2, g35017 or g35018 protein, for example the corresponding purified recombinant sbg1, g34665, sbg2, g35017 or g35018 protein produced by a recombinant cell host as described hereinbefore, in order to form a complex between this protein and the putative ligand molecule to be tested.

As an illustrative example, to study the interaction of the sbg1, g34665, sbg2, g35017 and g35018 protein, or a fragment comprising a contiguous span of at least 4 amino acids, preferably at least 6, or preferably at least 8 to 10 amino acids, more preferably at least 12, 15, 20, 25, 30, 40, 50, or 100 amino acids of SEQ ID Nos 27 to 35 and 41 to 43, with drugs or small molecules, such as molecules generated through combinatorial chemistry approaches, the microdialysis coupled to HPLC method described by Wang et al. (1997) or the affinity capillary electrophoresis method described by Bush et al. (1997), the disclosures of which are incorporated by reference, can be used.

In further methods, peptides, drugs, fatty acids, lipoproteins, or small molecules which interact with the sbg1, g34665, sbg2, g35017 or g35018 protein, or a fragment comprising a contiguous span of at least 4 amino acids, preferably at least 6, or preferably at least 8 to 10 amino acids, more preferably at least 12, 15, 20, 25, 30, 40, 50, or 100 amino acids of SEQ ID Nos 27 to 35 and 41 to 43, may be identified using assays such as the following. The molecule to be tested for binding is labeled with a detectable label, such as a fluorescent, radioactive, or enzymatic tag and placed in contact with immobilized sbg1, g34665, sbg2, g35017 or g35018 protein, or a fragment thereof under conditions which permit specific binding to occur. After removal of non-specifically bound molecules, bound molecules are detected using appropriate means.

Another object of the present invention comprises methods and kits for the screening of candidate substances that interact with an sbg1, g34665, sbg2, g35017 or g35018 polypeptide.

The present invention pertains to methods for screening substances of interest that interact with an sbg1, g34665, sbg2, g35017 or g35018 protein or one fragment or variant thereof. By their capacity to bind covalently or non-covalently to an sbg1, g34665, sbg2, g35017 or g35018 protein or to a fragment or variant thereof, these substances or molecules may be advantageously used both in vitro and in vivo.

In vitro, said interacting molecules may be used as detection means in order to identify the presence of an sbg1, g34665, sbg2, g35017 or g35018 protein in a sample, preferably a biological sample.

A method for the screening of a candidate substance comprises the following steps:

a) providing a polypeptide comprising, consisting essentially of, or consisting of an sbg1, g34665, sbg2, g35017 or g35018 protein or a fragment comprising a contiguous span of at least 4 amino acids, preferably at least 6 amino acids, more preferably at least 8 to 10 amino acids, more preferably at least 12, 15, 20, 25, 30, 40, 50, or 100 amino acids of SEQ ID Nos. 27 to 35 and 41 to 43;

b) obtaining a candidate substance;

c) bringing into contact said polypeptide with said candidate substance; and d) detecting the complexes formed between said polypeptide and said candidate substance.

The invention further concerns a kit for the screening of a candidate substance interacting with the sbg1, g34665, sbg2, g35017 or g35018 polypeptide, wherein said kit comprises:

a) an sbg1, g34665, sbg2, g35017 or g35018 protein having an amino acid sequence selected from the group consisting of the amino acid sequences of SEQ ID Nos. 27 to 35 and 41 to 43 or a peptide fragment comprising a contiguous span of at least 4 amino acids, preferably at least 6 amino acids, more preferably at least 8 to 10 amino acids, and more preferably at least 12, 15, 20, 25, 30, 40, 50, or 100 amino acids of SEQ ID Nos. 27 to 35 and 41 to 43; and b) optionally means useful to detect the complex formed between the sbg1, g34665, sbg2, g35017 or g35018 protein or a peptide fragment or a variant thereof and the candidate substance.

In a preferred embodiment of the kit described above, the detection means comprise monoclonal or polyclonal antibodies directed against the sbg1, g34665, sbg2, g35017 or g35018 protein or a peptide fragment or a variant thereof.

Various candidate substances or molecules can be assayed for interaction with an sbg1, g34665, sbg2, g35017 or g35018 polypeptide. These substances or molecules include, without being limited to, natural or synthetic organic compounds or molecules of biological origin such as polypeptides. When the candidate substance or molecule comprise a polypeptide, this polypeptide may be the resulting expression product of a phage clone belonging to a phage-based random peptide library, or alternatively the polypeptide may be the resulting expression product of a cDNA library cloned in a vector suitable for performing a two-hybrid screening assay.

The invention also pertains to kits useful for performing the hereinbefore described screening method. Preferably, such kits comprise an sbg1, g34665, sbg2, g35017 or g35018 polypeptide or a fragment or a variant thereof, and optionally means useful to detect the complex formed between the sbg1, g34665, sbg2, g35017 or g35018 polypeptide or its fragment or variant and the candidate substance. In a preferred embodiment the detection means comprise monoclonal or polyclonal antibodies directed against the corresponding sbg1, g34665, sbg2, g35017 or g35018 polypeptide or a fragment or a variant thereof.

A. Candidate Ligands Obtained from Random Peptide Libraries

In a particular embodiment of the screening method, the putative ligand is the expression product of a DNA insert contained in a phage vector (Parmley and Smith, 1988). Specifically, random peptide phages libraries are used. The random DNA inserts encode for peptides of 8 to 20 amino acids in length (Oldenburg K. R. et al., 1992; Valadon P., et al., 1996; Lucas A. H., 1994; Westerink M. A. J., 1995; Felici F. et al., 1991). According to this particular embodiment, the recombinant phages expressing a protein that binds to the immobilized sbg1, g34665, sbg2, g35017 or g35018 protein is retained and the complex formed between the sbg1, g34665, sbg2, g35017 or g35018 protein and the recombinant phage may be subsequently immunoprecipitated by a polyclonal or a monoclonal antibody directed against the sbg1, g34665, sbg2, g35017 or g35018 protein.

Once the ligand library in recombinant phages has been constructed, the phage population is brought into contact with the immobilized sbg1, g34665, sbg2, g35017 or g35018 protein. Then the preparation of complexes is washed in order to remove the non-specifically bound recombinant phages. The phages that bind specifically to the sbg1, g34665, sbg2, g35017 or g35018 protein are then eluted by a buffer (acid pH) or immunoprecipitated by the monoclonal antibody produced by the hybridoma anti-sbg1, g34665, sbg2, g35017 or g35018, and this phage population is subsequently amplified by an over-infection of bacteria (for example E. coli). The selection step may be repeated several times, preferably 2–4 times, in order to select the more specific recombinant phage clones. The last step comprises characterizing the peptide produced by the selected recombinant phage clones either by expression in infected bacteria and isolation, expressing the phage insert in another host-vector system, or sequencing the insert contained in the selected recombinant phages.

B. Candidate Ligands Obtained by Competition Experiments.

Alternatively, peptides, drugs or small molecules which bind to the sbg1, g34665, sbg2, g35017 or g35018 protein, or a fragment comprising a contiguous span of at least 4 amino acids, preferably at least 6 amino acids, more preferably at least 8 to 10 amino acids, and more preferably at least 12, 15, 20, 25, 30, 40, 50, or 100 amino acids of SEQ ID Nos. 27 to 35 and 41 to 43, may be identified in competition experiments. In such assays, the sbg1, g34665, sbg2, g35017 or g35018 protein, or a fragment thereof, is immobilized to a surface, such as a plastic plate. Increasing amounts of the peptides, drugs or small molecules are placed in contact with the immobilized sbg1, g34665, sbg2, g35017 or g35018 protein, or a fragment thereof, in the presence of a detectable labeled known sbg1, g34665, sbg2, g35017 or g35018 protein ligand. For example, the sbg1, g34665, sbg2, g35017 or g35018 ligand may be detectably labeled with a fluorescent, radioactive, or enzymatic tag. The ability of the test molecule to bind the sbg1, g34665, sbg2, g35017 or g35018 protein, or a fragment thereof, is determined by measuring the amount of detectably labeled known ligand bound in the presence of the test molecule. A decrease in the amount of known ligand bound to the sbg1, g34665, sbg2, g35017 or g35018 protein, or a fragment thereof, when the test molecule is present indicated that the test molecule is able to bind to the sbg1, g34665, sbg2, g35017 or g35018 protein, or a fragment thereof.

C. Candidate Ligands Obtained by Affinity Chromatography.

Proteins or other molecules interacting with the sbg1, g34665, sbg2, g35017 or g35018 protein, or a fragment comprising a contiguous span of at 4 amino acids, preferably at least 6 amino acids, more preferably at least 8 to 10 amino acids, and more preferably at least 12, 15, 20, 25, 30, 40, 50, or 100 amino acids of SEQ ID Nos 27 to 35 and 41 to 43, can also be found using affinity columns which contain the sbg1, g34665, sbg2, g35017 or g35018 protein, or a fragment thereof. The sbg1, g34665, sbg2, g35017 or g35018 protein, or a fragment thereof, may be attached to the column using conventional techniques including chemical coupling to a suitable column matrix such as agarose, Affi Gel®, or other matrices familiar to those of skill in art. In some embodiments of this method, the affinity column contains chimeric proteins in which the sbg1, g34665, sbg2, g35017 or g35018 protein, or a fragment thereof, is fused to glutathion S transferase (GST). A mixture of cellular proteins or pool of expressed proteins as described above is applied to the affinity column. Proteins or other molecules interacting with the sbg1, g34665, sbg2, g35017 or g35018 protein, or a fragment thereof, attached to the column can then be isolated and analyzed on 2-D electrophoresis gel as described in Ramunsen et al. (1997), the disclosure of which is incorporated by reference. Alternatively, the proteins retained on the affinity column can be purified by electrophoresis based methods and sequenced. The same method can be used to isolate antibodies, to screen phage display products, or to screen phage display human antibodies.

D. Candidate Ligands Obtained by Optical Biosensor Methods

Proteins interacting with the sbg1, g34665, sbg2, g35017 or g35018 protein, or a fragment comprising a contiguous span of at least 4 amino acids, preferably at least 6 amino acids, more preferably at least 8 to 10 amino acids, and more preferably at least 12, 15, 20, 25, 30, 40, 50, or 100 amino acids of SEQ ID Nos. 27 to 35 and 41 to 43, can also be screened by using an Optical Biosensor as described in Edwards and Leatherbarrow (1997) and also in Szabo et al. (1995), the disclosure of which is incorporated by reference. This technique permits the detection of interactions between molecules in real time, without the need of labeled molecules. This technique is based on the surface plasmon resonance (SPR) phenomenon. Briefly, the candidate ligand molecule to be tested is attached to a surface (such as a carboxymethyl dextran matrix). A light beam is directed towards the side of the surface that does not contain the sample to be tested and is reflected by said surface. The SPR phenomenon causes a decrease in the intensity of the reflected light with a specific association of angle and wavelength. The binding of candidate ligand molecules cause a change in the refraction index on the surface, which change is detected as a change in the SPR signal. For screening of candidate ligand molecules or substances that are able to interact with the sbg1, g34665, sbg2, g35017 or g35018 protein, or a fragment thereof, the sbg1, g34665, sbg2, g35017 or g35018 protein, or a fragment thereof, is immobilized onto a surface. This surface comprises one side of a cell through which flows the candidate molecule to be assayed. The binding of the candidate molecule on the sbg1, g34665, sbg2, g35017 or g35018 protein, or a fragment thereof, is detected as a change of the SPR signal. The candidate molecules tested may be proteins, peptides, carbohydrates, lipids, or small molecules generated by combinatorial chemistry. This technique may also be performed by immobilizing eukaryotic or prokaryotic cells or lipid vesicles exhibiting an endogenous or a recombinantly expressed sbg1, g34665, sbg2, g35017 or g35018 protein at their surface.

The main advantage of the method is that it allows the determination of the association rate between the sbg1, g34665, sbg2, g35017 or g35018 protein and molecules interacting with the sbg1, g34665, sbg2, g35017 or g35018 protein. It is thus possible to select specifically ligand molecules interacting with the sbg1, g34665, sbg2, g35017 or g35018 protein, or a fragment thereof, through strong or conversely weak association constants.

E. Candidate Ligands Obtained Through a Two-hybrid Screening Assay.

The yeast two-hybrid system is designed to study protein-protein interactions in vivo (Fields and Song, 1989), and relies upon the fusion of a bait protein to the DNA binding domain of the yeast Gal4 protein. This technique is also described in the U.S. Pat. No. 5,667,973 and the U.S. Pat. No. 5,283,173 (Fields et al.) the technical teachings of both patents being herein incorporated by reference.

The general procedure of library screening by the two-hybrid assay may be performed as described by Harper et al. (1993) or as described by Cho et al. (1998) or also Fromont-Racine et al. (1997).

The bait protein or polypeptide comprises, consists essentially of, or consists of an sbg1, g34665, sbg2, g35017 or g35018 polypeptide or a fragment comprising a contiguous span of at least 4 amino acids, preferably at least 6 amino acids, more preferably at least 8 to 10 amino acids, and more preferably at least 12, 15, 20, 25, 30, 40, 50, or 100 amino acids of SEQ ID Nos. 27 to 35 and 41 to 43.

More precisely, the nucleotide sequence encoding the sbg1, g34665, sbg2, g35017 or g35018 polypeptide or a fragment or variant thereof is fused to a polynucleotide encoding the DNA binding domain of the GAL4 protein, the fused nucleotide sequence being inserted in a suitable expression vector, for example pAS2 or pM3.

Then, a human cDNA library is constructed in a specially designed vector, such that the human cDNA insert is fused to a nucleotide sequence in the vector that encodes the transcriptional domain of the GAL4 protein. Preferably, the vector used is the pACT vector. The polypeptides encoded by the nucleotide inserts of the human cDNA library are termed "prey" polypeptides.

A third vector contains a detectable marker gene, such as beta galactosidase gene or CAT gene that is placed under the control of a regulation sequence that is responsive to the binding of a complete Gal4 protein containing both the transcriptional activation domain and the DNA binding domain. For example, the vector pG5EC may be used.

Two different yeast strains are also used. As an illustrative but non limiting example the two different yeast strains may be the followings:

Y190, the phenotype of which is (MATa, Leu2-3, 112 ura3-12, trp1-901, his3-D200, ade2-101, gal4Dgal180D URA3 GAL-LacZ, LYS GAL-HIS3, cyh$^r$);

Y187, the phenotype of which is (MATa gal4 gal80 his3 trp1-901 ade2-101 ura3-52 leu2-3, 112 URA3 GAL-lacZmef), which is the opposite mating type of Y190.

Briefly, 20 µg of pAS2/sbg1, g34665, sbg2, g35017 or g35018 and 20 µg of pACT-cDNA library are co-transformed into yeast strain Y190. The transformants are selected for growth on minimal media lacking histidine, leucine and tryptophan, but containing the histidine synthesis inhibitor 3-AT (50 mM). Positive colonies are screened for beta galactosidase by filter lift assay. The double positive colonies (His+, beta-gal+) are then grown on plates lacking histidine, leucine, but containing tryptophan and cycloheximide (10 mg/ml) to select for loss of pAS2/sbg1, g34665, sbg2, g35017 and g35018 plasmids bu retention of pACT-cDNA library plasmids. The resulting Y190 strains are mated with Y187 strains expressing sbg1, g34665, sbg2, g35017 and g35018 or non-related control proteins; such as cyclophilin B, lamin, or SNF1, as Gal4 fusions as described by Harper et al. (1993) and by Bram et al. (Bram R J et al., 1993), and screened for beta galactosidase by filter lift assay. Yeast clones that are beta gal-after mating with the control Gal4 fusions are considered false positives.

In another embodiment of the two-hybrid method according to the invention, interaction between the sbg1, g34665, sbg2, g35017 or g35018 or a fragment or variant thereof with cellular proteins may be assessed using the Matchmaker Two Hybrid System 2 (Catalog No. K1604-1, Clontech). As described in the manual accompanying the Matchmaker Two Hybrid System 2 (Catalog No. K1604-1, Clontech), the disclosure of which is incorporated herein by reference, nucleic acids encoding the sbg1, g34665, sbg2, g35017 and g35018 protein or a portion thereof, are inserted into an expression vector such that they are in frame with DNA encoding the DNA binding domain of the yeast transcriptional activator GAL4. A desired cDNA, preferably human cDNA, is inserted into a second expression vector such that they are in frame with DNA encoding the activation domain of GAL4. The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive for both the histidine selection and the lacZ assay contain sequences that permit, facilitate, or lead to interaction between sbg1, g34665, sbg2, g35017 or g35018 and the protein or peptide encoded by the initially selected cDNA insert; including the interacting sequences themselves.

Method for Screening Substances Interacting with the Regulatory Sequences of an sbg1, g34665, sbg2, g35017 or g35018 Gene.

The present invention also concerns a method for screening substances or molecules that are able to interact with the regulatory sequences of the sbg1, g34665, sbg2, g35017 or g35018 gene, such as for example promoter or enhancer sequences.

Nucleic acids encoding proteins which are able to interact with the regulatory sequences of the sbg1, g34665, sbg2, g35017 or g35018 gene, more particularly a nucleotide sequence selected from the group consisting of the polynucleotides of the 5' and 3' regulatory region or a fragment or variant thereof, and preferably a variant comprising one of the biallelic markers of the invention, may be identified by using a one-hybrid system, such as that described in the booklet enclosed in the Matchmaker One-Hybrid System kit from Clontech (Catalog Ref. n° K1603-1), the technical teachings of which are herein incorporated by reference. Briefly, the target nucleotide sequence is cloned upstream of a selectable reporter sequence and the resulting DNA construct is integrated in the yeast genome (*Saccharomyces cerevisiae*). The yeast cells containing the reporter sequence in their genome are then transformed with a library comprising fusion molecules between cDNAs encoding candidate proteins for binding onto the regulatory sequences of the sbg1, g34665, sbg2, g35017 or g35018 gene and sequences encoding the activator domain of a yeast transcription factor such as GAL4. The recombinant yeast cells are plated in a culture broth for selecting cells expressing the reporter sequence. The recombinant yeast cells thus selected contain a fusion protein that is able to bind onto the target regulatory sequence of the sbg1, g34665, sbg2, g35017 or g35018 gene. Then, the cDNAs encoding the fusion proteins are sequenced and may be cloned into expression or transcription vectors in vitro. The binding of the encoded polypeptides to the target regulatory sequences of the sbg1, g34665, sbg2, g35017 or g35018 gene may be confirmed by techniques familiar to the one skilled in the art, such as gel retardation assays or DNAse protection assays.

Gel retardation assays may also be performed independently in order to screen candidate molecules that are able to interact with the regulatory sequences of the sbg1, g34665, sbg2, g35017 or g35018 gene, such as described by Fried and Crothers (1981), Garner and Revzin (1981) and Dent and Latchman (1993), the teachings of these publications being herein incorporated by reference. These techniques are based on the principle according to which a DNA fragment which is bound to a protein migrates slower than the same unbound DNA fragment. Briefly, the target nucleotide sequence is labeled. Then the labeled target nucleotide sequence is brought into contact with either a total nuclear extract from cells containing transcription factors, or with different candidate molecules to be tested. The interaction between the target regulatory sequence of the sbg1, g34665, sbg2, g35017 or g35018 gene and the candidate molecule or the transcription factor is detected after gel or capillary electrophoresis through a retardation in the migration.

Method for Screening Ligands that Modulate the Expression of the sbg1, g34665, sbg2, g35017 or g35018 Gene Another subject of the present invention is a method for screening molecules that modulate the expression of the sbg1, g34665, sbg2, g35017 or g35018 protein. Such a screening method comprises the steps of:

a) cultivating a prokaryotic or an eukaryotic cell that has been transfected with a nucleotide sequence encoding the sbg1, g34665, sbg2, g35017 or g35018 protein or a variant or a fragment thereof, placed under the control of its own promoter;

b) bringing into contact the cultivated cell with a molecule to be tested;

c) quantifying the expression of the sbg1, g34665, sbg2, g35017 or g35018 protein or a variant or a fragment thereof.

In an embodiment, the nucleotide sequence encoding the sbg1, g34665, sbg2, g35017 or g35018 protein or a variant or a fragment thereof comprises an allele of at least one sbg1, g34665, sbg2, g35017 or g35018 related biallelic marker.

Using DNA recombination techniques well known by the one skill in the art, the sbg1, g34665, sbg2, g35017 or g35018 protein encoding DNA sequence is inserted into an expression vector, downstream from its promoter sequence. As an illustrative example, the promoter sequence of the sbg1, g34665, sbg2, g35017 or g35018 gene is contained in the nucleic acid of the 5' regulatory region.

The quantification of the expression of the sbg1, g34665, sbg2, g35017 or g35018 protein may be realized either at the mRNA level or at the protein level. In the latter case, polyclonal or monoclonal antibodies may be used to quantify the amounts of the sbg1, g34665, sbg2, g35017 or g35018 protein that have been produced, for example in an ELISA or a RIA assay.

In a preferred embodiment, the quantification of the sbg1, g34665, sbg2, g35017 or g35018 mRNA is realized by a quantitative PCR amplification of the cDNA obtained by a reverse transcription of the total mRNA of the cultivated sbg1, g34665, sbg2, g35017 or g35018-transfected host cell, using a pair of primers specific for sbg1, g34665, sbg2, g35017 or g35018.

The present invention also concerns a method for screening substances or molecules that are able to increase, or in contrast to decrease, the level of expression of the sbg1, g34665, sbg2, g35017 or g35018 gene. Such a method may allow the one skilled in the art to select substances exerting a regulating effect on the expression level of the sbg1, g34665, sbg2, g35017 or g35018 gene and which may be useful as active ingredients included in pharmaceutical compositions for treating patients suffering from diseases.

Thus, is also part of the present invention a method for screening of a candidate substance or molecule that modulated the expression of the sbg1, g34665, sbg2, g35017 or g35018 gene, this method comprises the following steps:

providing a recombinant cell host containing a nucleic acid, wherein said nucleic acid comprises a nucleotide sequence of the 5' regulatory region or a biologically active fragment or variant thereof located upstream a polynucleotide encoding a detectable protein;

obtaining a candidate substance; and determining the ability of the candidate substance to modulate the expression levels of the polynucleotide encoding the detectable protein.

In a further embodiment, the nucleic acid comprising the nucleotide sequence of the 5' regulatory region or a biologically active fragment or variant thereof also includes a 5' UTR region of the sbg1 cDNA of SEQ ID No 2 to 26 or the g35018 cDNA of SEQ ID No 36 to 40, or one of its biologically active fragments or variants thereof.

Among the preferred polynucleotides encoding a detectable protein, there may be cited polynucleotides encoding beta galactosidase, green fluorescent protein (GFP) and chloramphenicol acetyl transferase (CAT).

The invention also pertains to kits useful for performing the herein described screening method. Preferably, such kits comprise a recombinant vector that allows the expression of a nucleotide sequence of the 5' regulatory region or a biologically active fragment or variant thereof located upstream and operably linked to a polynucleotide encoding a detectable protein or the sbg1, g34665, sbg2, g35017 or g35018 protein or a fragment or a variant thereof.

In another embodiment of a method for the screening of a candidate substance or molecule that modulates the expression of the sbg1, g34665, sbg2, g35017 or g35018 gene, wherein said method comprises the following steps:

a) providing a recombinant host cell containing a nucleic acid, wherein said nucleic acid comprises a 5' UTR sequence of an sbg1, g34665, sbg2, g35017 or g35018 cDNA, preferably of an sbg1 or g35018 cDNA of SEQ ID Nos 2 to 26 or 36 to 40, or one of its biologically active fragments or variants, the 5' UTR sequence or its biologically active fragment or variant being operably linked to a polynucleotide encoding a detectable protein;

b) obtaining a candidate substance; and c) determining the ability of the candidate substance to modulate the expression levels of the polynucleotide encoding the detectable protein.

In a specific embodiment of the above screening method, the nucleic acid that comprises a nucleotide sequence selected from the group consisting of the 5' UTR sequence of an sbg1, g34665, sbg2, g35017 or g35018 cDNA, preferably of an sbg1 or g35018 cDNA of SEQ ID Nos 2 to 26 or 36 to 40 or one of its biologically active fragments or variants, includes a promoter sequence which is endogenous with respect to the sbg1, g34665, sbg2, g35017 or g35018 5' UTR sequence.

In another specific embodiment of the above screening method, the nucleic acid that comprises a nucleotide sequence selected from the group consisting of the 5' UTR sequence of an sbg1, g34665, sbg2, g35017 or g35018 cDNA or one of its biologically active fragments or variants, includes a promoter sequence which is exogenous with respect to the sbg1, g34665, sbg2, g35017 or g35018 5' UTR sequence defined therein.

In a further preferred embodiment, the nucleic acid comprising the 5'-UTR sequence of an sbg1, g34665, sbg2, g35017 or g35018 cDNA or the biologically active fragments thereof includes an sbg1-related biallelic marker.

The invention further comprises a kit for the screening of a candidate substance modulating the expression of the sbg1, g34665, sbg2, g35017 or g35018 gene, wherein said kit comprises a recombinant vector that comprises a nucleic acid including a 5' UTR sequence of the sbg1, g34665, sbg2, g35017 or g35018 cDNA of SEQ ID Nos 2 to 26 or 36 to 40, or one of their biologically active fragments or variants, the 5' UTR sequence or its biologically active fragment or variant being operably linked to a polynucleotide encoding a detectable protein.

For the design of suitable recombinant vectors useful for performing the screening methods described above, it will be referred to the section of the present specification wherein the preferred recombinant vectors of the invention are detailed.

Expression levels and patterns of sbg1, g34665, sbg2, g35017 or g35018 may be analyzed by solution hybridization with long probes as described in International Patent Application No. WO 97/05277, the entire contents of which are incorporated herein by reference. Briefly, the sbg1, g34665, sbg2, g35017 or g35018 cDNA or the sbg1, g34665, sbg2, g35017 and g35018 genomic DNA described above, or fragments thereof, is inserted at a cloning site immediately downstream of a bacteriophage (T3, T7 or SP6) RNA polymerase promoter to produce antisense RNA. Preferably, the sbg1, g34665, sbg2, g35017 and g35018 insert comprises at least 100 or more consecutive nucleotides of the genomic DNA sequence or the cDNA sequences. The plasmid is linearized and transcribed in the presence of ribonucleotides comprising modified ribonucleotides (i.e. biotin-UTP and DIG-UTP). An excess of this doubly labeled RNA is hybridized in solution with mRNA isolated from cells or tissues of interest. The hybridization is performed under standard stringent conditions (40–50° C. for 16 hours in an 80% formamide, 0.4 M NaCl buffer, pH 7–8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

Quantitative analysis of sbg1, g34665, sbg2, g35017 or g35018 gene expression may also be performed using arrays. As used herein, the term array means a one dimensional, two dimensional, or multidimensional arrangement of a plurality of nucleic acids of sufficient length to permit specific detection of expression of mRNAs capable of hybridizing thereto. For example, the arrays may contain a plurality of nucleic acids derived from genes whose expression levels are to be assessed. The arrays may include the sbg1, g34665, sbg2, g35017 and g35018 genomic DNA, the sbg1, g34665, sbg2, g35017 or g35018 cDNA sequences or the sequences complementary thereto or fragments thereof, particularly those comprising at least one of the biallelic markers according the present invention. Preferably, the fragments are at least 15 nucleotides in length. In other embodiments, the fragments are at least 25 nucleotides in length. In some embodiments, the fragments are at least 50 nucleotides in length. More preferably, the fragments are at least 100 nucleotides in length. In another preferred embodiment, the fragments are more than 100 nucleotides in length. In some embodiments the fragments may be more than 500 nucleotides in length.

For example, quantitative analysis of sbg1, g34665, sbg2, g35017 or g35018 gene expression may be performed with a complementary DNA microarray as described by Schena et al. (1995 and 1996). Full length sbg1, g34665, sbg2, g35017 or g35018 cDNAs or fragments thereof are amplified by PCR and arrayed from a 96-well microtiter plate onto silylated microscope slides using high-speed robotics. Printed arrays are incubated in a humid chamber to allow rehydration of the array elements and rinsed, once in 0.2% SDS for 1 min, twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C.

Cell or tissue mRNA is isolated or commercially obtained and probes are prepared by a single round of reverse transcription. Probes are hybridized to 1 cm$^2$ microarrays under a 14×14 mm glass coverslip for 6–12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of sbg1, g34665, sbg2, g35017 or g35018 gene expression may also be performed with full length sbg1, g34665, sbg2, g35017 or g35018 cDNAs or fragments thereof in complementary DNA arrays as described by Pietu et al. (1996). The full length sbg1, g34665, sbg2, g35017 or g35018 cDNA or fragments thereof is PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis using the sbg1, g34665, sbg2, g35017 or g35018 genomic DNA, the sbg1, g34665, sbg2, g35017 or g35018 cDNA, or fragments thereof can be done through high density nucleotide arrays as described by Lockhart et al. (1996) and Sosnowsky et al. (1997). Oligonucleotides of 15–50 nucleotides from the sequences of the sbg1, g34665, sbg2, g35017 or g35018 genomic DNA, the sbg1, g34665, sbg2, g35017 or g35018 cDNA sequences particularly those comprising at least one of biallelic markers according the present invention, or the sequences complementary thereto, are synthesized directly on the chip (Lockhart et al., supra) or synthesized and then addressed to the chip (Sosnowski et al., supra). Preferably, the oligonucleotides are about 20 nucleotides in length.

sbg1, g34665, sbg2, g35017 or g35018 cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip. After washing as described in Lockhart et al., supra and application of different electric fields (Sosnowsky et al., 1997)., the dyes or labeling compounds are detected and quantified. Duplicate hybridizations are performed. Comparative analysis of the intensity of the signal originating from cDNA probes on the same target oligonucleotide in different cDNA samples indicates a differential expression of sbg1, g34665, sbg2, g35017 or g35018 mRNA.

Methods for Inhibiting the Expression of an sbg1, g34665, sbg2, g35017 or g35018 Gene Other therapeutic compositions according to the present invention comprise advantageously an oligonucleotide fragment of the nucleic sequence of sbg1, g34665, sbg2, g35017 or g35018 as an antisense tool or a triple helix tool that inhibits the expression of the corresponding sbg1, g34665, sbg2, g35017 or g35018 gene. A preferred fragment of the nucleic sequence of sbg1, g34665, sbg2, g35017 or g35018 comprises an allele of at least one of the biallelic markers of the invention.

Antisense Approach

Preferred methods using antisense polynucleotide according to the present invention are the procedures described by Sczakiel et al. (1995), the disclosure of which is incorporated herein by reference.

Preferably, the antisense tools are chosen among the polynucleotides (15–200 bp long) that are complementary to the 5'end of the sbg1, g34665, sbg2, g35017 or g35018 mRNA. In another embodiment, a combination of different antisense polynucleotides complementary to different parts of the desired targeted gene are used.

Preferred antisense polynucleotides according to the present invention are complementary to a sequence of the mRNAs of sbg1, g34665, sbg2, g35017 or g35018 that contains either the translation initiation codon ATG or a splicing donor or acceptor site.

The antisense nucleic acids should have a length and melting temperature sufficient to permit formation of an intracellular duplex having sufficient stability to inhibit the expression of the sbg1, g34665, sbg2, g35017 or g35018 mRNA in the duplex. Strategies for designing antisense nucleic acids suitable for use in gene therapy are disclosed in Green et al., (1986) and Izant and Weintraub, (1984), the disclosures of which are incorporated herein by reference.

In some strategies, antisense molecules are obtained by reversing the orientation of the sbg1, g34665, sbg2, g35017 or g35018 coding region with respect to a promoter so as to transcribe the opposite strand from that which is normally transcribed in the cell. The antisense molecules may be transcribed using in vitro transcription systems such as those which employ T7 or SP6 polymerase to generate the transcript. Another approach involves transcription of sbg1, g34665, sbg2, g35017 or g35018 antisense nucleic acids in vivo by operably linking DNA containing the antisense sequence to a promoter in a suitable expression vector.

Alternatively, suitable antisense strategies are those described by Rossi et al. (1991), in the International Applications Nos. WO 94/23026, WO 95/04141, WO 92/18522 and in the European Patent Application No. EP 0 572 287 A2, the disclosures of which are incorporated herein by reference An alternative to the antisense technology that is used according to the present invention comprises using ribozymes that will bind to a target sequence via their complementary polynucleotide tail and that will cleave the corresponding RNA by hydrolyzing its target site (namely "hammerhead ribozymes"). Briefly, the simplified cycle of a hammerhead ribozyme comprises (1) sequence specific binding to the target RNA via complementary antisense sequences; (2) site-specific hydrolysis of the cleavable motif of the target strand; and (3) release of cleavage products, which gives rise to another catalytic cycle. Indeed, the use of long-chain antisense polynucleotide (at least 30 bases long) or ribozymes with long antisense arms are advantageous. A preferred delivery system for antisense ribozyme is achieved by covalently linking these antisense ribozymes to lipophilic groups or to use liposomes as a convenient vector. Preferred antisense ribozymes according to the present invention are prepared as described by Sczakiel et al. (1995), the specific preparation procedures being referred to in said article being herein incorporated by reference.

Triple Helix Approach

The sbg1, g34665, sbg2, g35017 or g35018 genomic DNA may also be used to inhibit the expression of the sbg1, g34665, sbg2, g35017 or g35018 gene based on intracellular triple helix formation.

Triple helix oligonucleotides are used to inhibit transcription from a genome. They are particularly useful for studying alterations in cell activity when it is associated with a particular gene.

Similarly, a portion of the sbg1, g34665, sbg2, g35017 or g35018 genomic DNA can be used to study the effect of inhibiting sbg1, g34665, sbg2, g35017 or g35018 transcription within a cell. Traditionally, homopurine sequences were considered the most useful for triple helix strategies. However, homopyrimidine sequences can also inhibit gene expression. Such homopyrimidine oligonucleotides bind to the major groove at homopurine:homopyrimidine sequences. Thus, both types of sequences from the sbg1, g34665, sbg2, g35017 or g35018 genomic DNA are contemplated within the scope of this invention.

To carry out gene therapy strategies using the triple helix approach, the sequences of the sbg1, g34665, sbg2, g35017 or g35018 genomic DNA are first scanned to identify 10-mer to 20-mer homopyrimidine or homopurine stretches which could be used in triple-helix based strategies for inhibiting sbg1, g34665, sbg2, g35017 or g35018 expression. Following identification of candidate homopyrimidine or homopurine stretches, their efficiency in inhibiting sbg1, g34665, sbg2, g35017 or g35018 expression is assessed by introducing varying amounts of oligonucleotides containing the candidate sequences into tissue culture cells which express the sbg1, g34665, sbg2, g35017 or g35018 gene.

The oligonucleotides can be introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced sbg1, g34665, sbg2, g35017 or g35018 expression using techniques such as Northern blotting, RNase protection assays, or PCR based strategies to monitor the transcription levels of the sbg1, g34665, sbg2, g35017 or g35018 gene in cells which have been treated with the oligonucleotide.

The oligonucleotides which are effective in inhibiting gene expression in tissue culture cells may then be introduced in vivo using the techniques described above in the antisense approach at a dosage calculated based on the in vitro results, as described in antisense approach.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (1989), which is hereby incorporated by this reference.

Pharmaceutical Compositions and Formulations

Sbg1-modulating Compounds

Using the methods disclosed herein, compounds that selectively modulate sbg1 activity in vitro and in vivo may be identified. The compounds identified by the process of the invention include, for example, antibodies having binding specificity for the sbg1 peptide. It is also expected that homologues of sbg1 may be useful for modulating sbg1-mediated activity and the related physiological condition associated with schizophrenia or bipolar disorder. Generally, it is further expected that assay methods of the present invention based on the role of sbg1 in central nervous system disorder may be used to identify compounds capable of intervening in the assay cascade of the invention.

Indications

While sbg1 has demonstrated an association with schizophrenia and bipolar disorder, indications involving sbg1 may include various central nervous system disorders. Nervous system disorders are expected to have complex genetic bases and often share certain symptoms. In particular, as described herein, indications may include schizophrenia and other psychotic disorders, mood disorders, autism, substance dependence and alcoholism, mental retardation, and other psychiatric diseases including cognitive, anxiety, eating, impulse-control, and personality disorders, as defined with the Diagnosis and Statistical Manual of Mental Disorders fourth edition (DSM-IV) classification.

Pharmaceutical Formulations and Routes of Administration

The compounds identified using the methods of the present invention can be administered to a mammal, including a human patient, alone or in pharmaceutical compositions where they are mixed with suitable carriers or excipient(s) at therapeutically effective doses to treat or ameliorate schizophrenia or bipolar disorder related disorders. A therapeutically effective dose further refers to that amount of the compound sufficient to result in amelioration of symptoms as determined by the methods described herein. Preferably, a therapeutically effective dosage is suitable for continued periodic use or administration. Techniques for formulation and administration of the compounds of the instant application may be found in "Remington's Pharmaceutical Sciences," Mack Publishing Co., Easton, Pa., latest edition.

Routes of Administration

Suitable routes of administration include oral, rectal, transmucosal, or intestinal administration, parenteral delivery, including intramuscular, subcutaneous, intramedullary injections, as well as intrathecal, direct intraventricular, intravenous, intraperitoneal, intranasal or intraocular injections. A particularly useful method of administering compounds for treating central nervous system disease involves surgical implantation of a device for delivering the compound over an extended period of time.

Sustained release formulations of the invented medicaments particularly are contemplated.

Composition/Formulation

Pharmaceutical compositions and medicaments for use in accordance with the present invention may be formulated in a conventional manner using one or more physiologically acceptable carriers comprising excipients and auxiliaries. Proper formulation is dependent upon the route of administration chosen.

For injection, the agents of the invention may be formulated in aqueous solutions, preferably in physiologically compatible buffers such as Hanks's solution, Ringer's solution, or physiological saline buffer such as a phosphate or bicarbonate buffer. For transmucosal administration, penetrants appropriate to the barrier to be permeated are used in the formulation. Such penetrants are generally known in the art.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with fillers such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. All formulations for oral administration should be in dosages suitable for such administration.

For buccal administration, the compositions may take the form of tablets or lozenges formulated in conventional manner.

For administration by inhalation, the compounds for use according to the present invention are conveniently delivered in the form of an aerosol spray presentation from pressurized packs or a nebulizer, with the use of a suitable gaseous propellant, e.g., carbon dioxide. In the case of a pressurized aerosol the dosage unit may be determined by providing a valve to deliver a metered amount. Capsules and cartridges of, e.g., gelatin, for use in an inhaler or insufflator, may be formulated containing a powder mix of the compound and a suitable powder base such as lactose or starch.

The compounds may be formulated for parenteral administration by injection, e.g., by bolus injection or continuous infusion. Formulations for injection may be presented in unit dosage form, e.g., in ampoules or in multi-dose containers, with an added preservative. The compositions may take such forms as suspensions, solutions or emulsions in aqueous vehicles, and may contain formulatory agents such as suspending, stabilizing and/or dispersing agents.

Pharmaceutical formulations for parenteral administration include aqueous solutions of the active compounds in water-soluble form. Aqueous suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Alternatively, the active ingredient may be in powder or lyophilized form for constitution with a suitable vehicle, such as sterile pyrogen-free water, before use.

In addition to the formulations described previously, the compounds may also be formulated as a depot preparation. Such long acting formulations may be administered by implantation (for example subcutaneously or intramuscularly) or by intramuscular injection. Thus, for example, the compounds may be formulated with suitable polymeric or hydrophobic materials (for example as an emulsion in an acceptable oil) or ion exchange resins, or as sparingly soluble derivatives, for example, as a sparingly soluble salt.

Additionally, the compounds may be delivered using a sustained-release system, such as semipermeable matrices of solid hydrophobic polymers containing the therapeutic agent. Various sustained release materials have been established and are well known by those skilled in the art. Sustained-release capsules may, depending on their chemical nature, release the compounds for a few weeks up to over 100 days.

Depending on the chemical nature and the biological stability of the therapeutic reagent, additional strategies for protein stabilization may be employed.

The pharmaceutical compositions also may comprise suitable solid or gel phase carriers or excipients. Examples of such carriers or excipients include but are not limited to calcium carbonate, calcium phosphate, various sugars, starches, cellulose derivatives, gelatin, and polymers such as polyethylene glycols.

Effective Dosage.

Pharmaceutical compositions suitable for use in the present invention include compositions wherein the active ingredients are contained in an effective amount to achieve their intended purpose. More specifically, a therapeutically effective amount means an amount effective to prevent development of or to alleviate the existing symptoms of the subject being treated. Determination of the effective amounts is well within the capability of those skilled in the art, especially in light of the detailed disclosure provided herein.

For any compound used in the method of the invention, the therapeutically effective dose can be estimated initially from cell culture assays, and a dose can be formulated in animal models. Such information can be used to more accurately determine useful doses in humans.

A therapeutically effective dose refers to that amount of the compound that results in amelioration of symptoms in a patient. Toxicity and therapeutic efficacy of such compounds can be determined by standard pharmaceutical procedures in cell cultures or experimental animals, e.g., for determining the LD50, (the dose lethal to 50% of the test population) and the ED50 (the dose therapeutically effective in 50% of the population). The dose ratio between toxic and therapeutic effects is the therapeutic index and it can be expressed as the ratio between LD5O and ED5O. Compounds which exhibit high therapeutic indices are preferred.

The data obtained from these cell culture assays and animal studies can be used in formulating a range of dosage for use in human. The dosage of such compounds lies preferably within a range of circulating concentrations that include the ED50, with little or no toxicity. The dosage may vary within this range depending upon the dosage form employed and the route of administration utilized. The exact formulation, route of administration and dosage can be chosen by the individual physician in view of the patient's condition. (See, e.g., Fingl et al., 1975, in "The Pharmacological Basis of Therapeutics", Ch. 1).

Computer-related Embodiments

As used herein the term "nucleic acid codes of the invention" encompass the nucleotide sequences comprising, consisting essentially of, or consisting of any one of the following:

a) a contiguous span of at least 12, 15, 18, 20, 25, 30, 35, 40, 50, 60, 70, 80, 90, 100, 150, 200, 500, 1000 or 2000 nucleotides of SEQ ID No. 1, and the complements thereof, wherein said contiguous span comprises at least one of the following nucleotide positions of SEQ ID No 1: 31 to 292651 and 292844 to 319608.

b) a contiguous span of at least 12, 15, 18, 20, 25, 30, 35, 40, 50, 60, 70, 80, 90, 100, 150, 200, 500, 1000 or 2000 nucleotides of any of SEQ ID Nos. 54 to 229, and the complements thereof, to the extent that such a length is consistent with the particular sequence ID.

c) a contiguous span of at least 8, 12, 15, 18, 20, 25, 30, 35, 40, 45, 50, 55, 60, 65, 70, 75, 80, 90, 100 or 200 nucleotides, to the extent that such a length is consistent with the particular sequence ID, of SEQ ID Nos. 2 to 26, 36 to 40 or the complements thereof.

d) a contiguous span of at least 12, 15, 18, 20, 25, 30, 35, 40, 45, 50, 55, 60, 65, 70, 75, 80, 90 or 100 nucleotides of SEQ ID No. 1 or the complements thereof wherein said contiguous span comprises at least one of the following nucleotide positions of SEQ ID No 1:

(i) 292653 to 296047, 292653 to 292841, 295555 to 296047 and 295580 to 296047;

(ii) 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854;

(iii) 94124 to 94964;

(iv) 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685; and (v) 201188 to 216915, 201188 to 201234, 214676 to 214793, 215702 to 215746 and 216836 to 216915;

e) a contiguous span according to a), b), c) or d), wherein said span includes a biallelic marker selected from the group consisting of A1 to A489.

f) a contiguous span of at least 12, 15, 18, 20, 25, 30, 35, 40, 50, 60, 70, 80, 90, 100, 150, 200, 500, 1000 or 2000 nucleotides of SEQ ID No. 1 or the complements thereof, wherein said contiguous span comprises at least 1, 2, 3, 5, or 10 nucleotide positions of any one the ranges of nucleotide positions designated pos1 to pos166 of SEQ ID No. 1 listed in Table 1 above;

g) a contiguous span of at least 12, 15, 18, 20, 25, 30, 35, 40, 50, 60, 70, 80, 90, 100, 150, 200, 500, 1000 or 2000 nucleotides of any of SEQ ID Nos. 2 to 26, 36 to 42, 44 to 48 and 52 to 269, and the complements thereof, wherein said span includes a chromosome 13q31-q33-related biallelic marker, a Region D-related biallelic marker, an sbg1-, g34665-, sbg2-, g35017-or g35018-related biallelic marker;

h) a contiguous span of at least 12, 15, 18, 20, 25, 30, 35, 40, 50, 60, 70, 80, 90, 100, 150, 200, 500, 1000 or 2000 nucleotides of any of SEQ ID Nos 2 to 26, 36 to 40 and 54 to 229, and the complements thereof, wherein said span includes a chromosome 13q31-q33-related biallelic marker, a Region D-related biallelic marker, an sbg1-, g34665-, sbg2-, g35017- or g35018-related biallelic marker with the alternative allele present at said biallelic marker.

i) a contiguous span of at least 12, 15, 18, 20, 25, 30, 35, 40, 50, 60, 70, 80, 90, 100, 150, 200, 500, 1000 or 2000 nucleotides of any of SEQ ID No 1, and the complements thereof, wherein said span includes a polymorphism selected from the group consisting of A1 to A69, A71 to A74, A76 to A94, A96 to A106, A108 to A112, A114 to A177, A179 to A197, A199 to A222, A224 to A242 and 361 to A489.

The "nucleic acid codes of the invention" further encompass nucleotide sequences homologous to a contiguous span of at least 30, 35, 40, 50, 60, 70, 80, 90, 100, 150, 200, 500, 1000 or 2000 nucleotides, to the extent that such a length is consistent with the particular sequence of SEQ ID Nos. 1 to 26, 36 to 40 and 54 to 229, and the complements thereof. The "nucleic acid codes of the invention" also encompass nucleotide sequences homologous to a contiguous span of at least 12, 15, 18, 20, 25, 30, 35, 40, 45, 50, 55, 60, 65, 70, 75, 80, 90 or 100 nucleotides of SEQ ID No. 1 or the complements thereof, wherein said contiguous span comprises at least one of the following nucleotide positions of SEQ ID No. 1:

(i) 292653 to 296047, 292653 to 292841, 295555 to 296047 and 295580 to 296047;

(ii) 31 to 1107, 1108 to 65853, 1108 to 1289, 14877 to 14920, 18778 to 18862, 25593 to 25740, 29388 to 29502, 29967 to 30282, 64666 to 64812, 65505 to 65853 and 65854 to 67854;

(iii) 94124 to 94964;

(iv) 213818 to 215818, 215819 to 215941, 215819 to 215975, 216661 to 216952, 216661 to 217061, 217027 to 217061, 229647 to 229742, 230408 to 230721, 231272 to 231412, 231787 to 231880, 231870 to 231879, 234174 to 234321, 237406 to 237428, 239719 to 239807, 239719 to 239853, 240528 to 240569, 240528 to 240596, 240528 to 240617, 240528 to 240644, 240528 to 240824, 240528 to 240994, 240528 to 241685, 240800 to 240993 and 241686 to 243685; and (v) 201188 to 216915, 201188 to 201234, 214676 to 214793, 215702 to 215746 and 216836 to 216915.

Homologous sequences refer to a sequence having at least 99%, 98%, 97%, 96%, 95%, 90%, 85%, 80%, or 75% homology to these contiguous spans. Homology may be determined using any method described herein, including BLAST2N with the default parameters or with any modified parameters. Homologous sequences also may include RNA sequences in which uridines replace the thymines in the nucleic acid codes of the invention. It will be appreciated that the nucleic acid codes of the invention can be represented in the traditional single character format (See the inside back cover of Stryer, Lubert. *Biochemistry*, $3^{rd}$ edition. W. H Freeman & Co., New York.) or in any other format or code which records the identity of the nucleotides in a sequence.

As used herein the term "polypeptide codes of SEQ ID Nos. 27 to 35 and 41 to 43" encompasses the polypeptide sequence of SEQ ID Nos 27 to 35 and 41 to 43, polypeptide sequences homologous to the polypeptides of SEQ ID Nos. 27 to 35 and 41 to 43, or fragments of any of the preceding sequences. Homologous polypeptide sequences refer to a polypeptide sequence having at least 99%, 98%, 97%, 96%, 95%, 90%, 85%, 80%, 75% homology to one of the polypeptide sequences of SEQ ID Nos. 27 to 35 and 41 to 43. Homology may be determined using any of the computer programs and parameters described herein, including FASTA with the default parameters or with any modified parameters. The homologous sequences may be obtained using any of the procedures described herein or may result from the correction of a sequencing error as described above. The polypeptide fragments comprise at least 4, 6, 8, 10, 15, 20, 25, 30, 35, 40, 50, 75, 100, or 150 consecutive amino acids of the polypeptides of SEQ ID Nos. 27 to 35 and 41 to 43. Preferably, the fragments are novel fragments. It will be appreciated that the polypeptide codes of the SEQ ID Nos. 27 to 35 and 41 to 43 can be represented in the traditional single character format or three letter format (See the inside back cover of Starrier, Lubert. *Biochemistry*, 3$^{rd}$ edition. W. H Freeman & Co., New York.) or in any other format which relates the identity of the polypeptides in a sequence.

It will be appreciated by those skilled in the art that the nucleic acid codes of SEQ ID Nos. 1 to 26, 36 to 40 and 54 to 229 and polypeptide codes of SEQ ID Nos. 27 to 35 and 41 to 43 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate embodiment comprising one or more of nucleic acid codes of SEQ ID Nos. 1 to 26, 36 to 40 and 54 to 229, or one or more of the polypeptide codes of SEQ ID Nos. 27 to 35 and 41 to 43. Another aspect of the present invention is a computer readable medium having recorded thereon at least 2, 5, 10, 15, 20, 25, 30, or 50 nucleic acid codes of SEQ ID Nos 1 to 26, 36 to 40 and 54 to 229. Another aspect of the present invention is a computer readable medium having recorded thereon at least 2, 5, 10, 15, 20, 25, 30, or 50 polypeptide codes of SEQ ID Nos 27 to 35 and 41 to 43.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Figure 19:
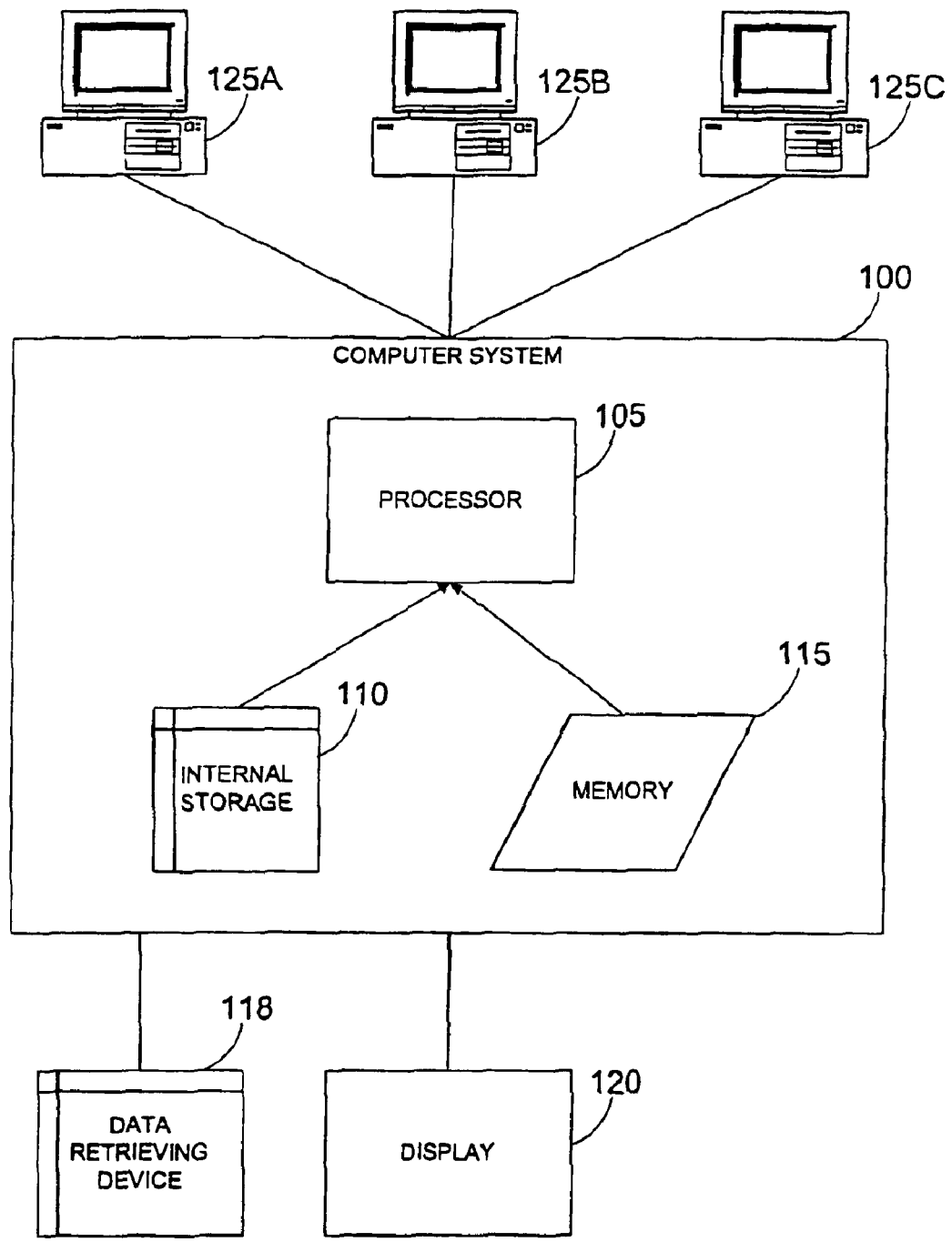
FIG. 19 is a block diagram of an exemplary computer system.

Embodiments of the present invention include systems, particularly computer systems which store and manipulate the sequence information described herein. One example of a computer system 100 is illustrated in block diagram form in FIG. 19. As used herein, "a computer system" refers to the hardware components, software components, and data storage components used to analyze the nucleotide sequences of the nucleic acid codes of SEQ ID Nos 1 to 26, 36 to 40 and 54 to 229, or the amino acid sequences of the polypeptide codes of SEQ ID Nos. 27 to 35 and 41 to 43. In one embodiment, the computer system 100 is a Sun Enterprise 1000 server (Sun Microsystems, Palo Alto, Calif.). The computer system 100 preferably includes a processor for processing, accessing and manipulating the sequence data. The processor 105 can be any well-known type of central processing unit, such as the Pentium III from Intel Corporation, or similar processor from Sun, Motorola, Compaq or International Business Machines.

Preferably, the computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 118 for reading the data stored on the internal data storage devices 110.

The data retrieving device 118 may represent, for example, a floppy disk drive, a compact disk drive, a magnetic tape drive, etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a–c in a network or wide area network to provide centralized access to the computer system 100.

Software for accessing and processing the nucleotide sequences of the nucleic acid codes of SEQ ID Nos. 1 to 26, 36 to 40 and 54 to 229, or the amino acid sequences of the polypeptide codes of SEQ ID Nos. 27 to 35 and 41 to 43 (such as search tools, compare tools, and modeling tools etc.) may reside in main memory 115 during execution.

In some embodiments, the computer system 100 may further comprise a sequence comparer for comparing the above-described nucleic acid codes of SEQ ID Nos. 1 to 26, 36 to 40 and 54 to 229 or polypeptide codes of SEQ ID Nos. 27 to 35 and 41 to 43 stored on a computer readable medium to reference nucleotide or polypeptide sequences stored on a computer readable medium. A "sequence comparer" refers to one or more programs which are implemented on the computer system 100 to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the nucleic acid codes of SEQ ID Nos. 1 to 26, 36 to 40 and 54 to 229, or the amino acid sequences of the polypeptide codes of SEQ ID Nos. 27 to 35 and 41 to 43 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

Figure 20:
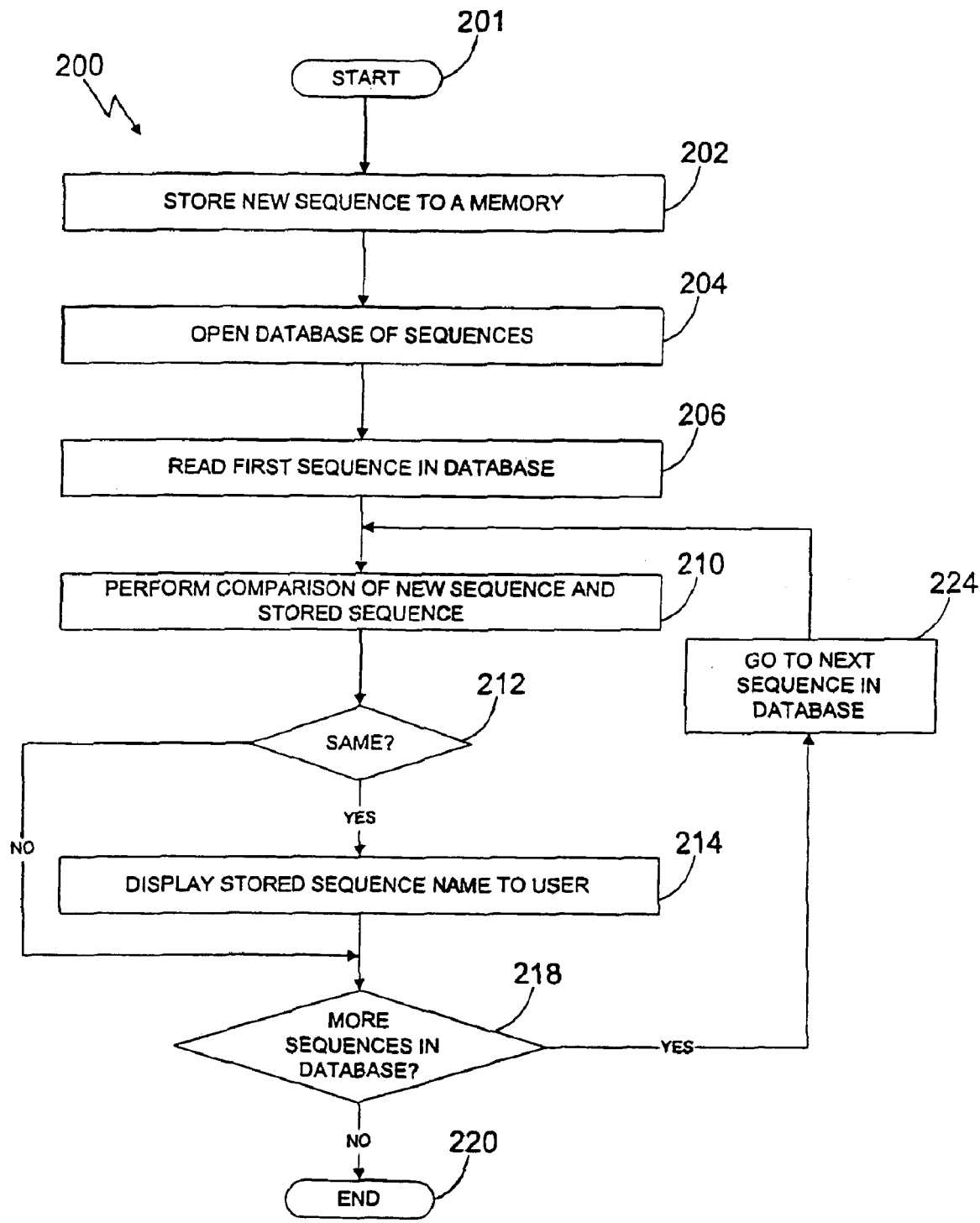
FIG. 20 is a flow diagram illustrating one embodiment of a process 200 for comparing a new nucleotide or protein sequence with a database of sequences in order to determine the homology levels between the new sequence and the sequences in the database.

FIG. 20 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK, PIR OR SWISSPROT that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the present invention is a computer system comprising a processor, a data storage device having stored thereon a nucleic acid code of SEQ ID NOs. 1 to 26, 36 to 40 and 54 to 229 or a polypeptide code of SEQ ID Nos 27 to 35 and 41 to 43, a data storage device having retrievably stored thereon reference nucleotide sequences or polypeptide sequences to be compared to the nucleic acid code of SEQ ID Nos. 1 to 26, 36 to 40 and 54 to 229 or polypeptide code of SEQ ID Nos. 27 to 35 and 41 to 43 and a sequence comparer for conducting the comparison. The sequence comparer may indicate a homology level between the sequences compared or identify structural motifs in the above described nucleic acid code of SEQ ID Nos. 1 to 26, 36 to 40 and 54 to 229 and polypeptide codes of SEQ ID Nos. 27 to 35 and 41 to 43 or it may identify structural motifs in sequences which are compared to these nucleic acid codes and polypeptide codes. In some embodiments, the data storage device may have stored thereon the sequences of at least 2, 5, 10, 15, 20, 25, 30, or 50 of the nucleic acid codes of SEQ ID Nos. 1 to 26, 36 to 40 and 54 to 229 or polypeptide codes of SEQ ID Nos. 27 to 35 and 41 to 43.

Another aspect of the present invention is a method for determining the level of homology between a nucleic acid code of SEQ ID Nos. 1 to 26, 36 to 40 and 54 to 229 and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described nucleic acid codes of SEQ ID Nos. 1 to 26, 36 to 40 and 54 to 229 through use of the computer program and determining homology between the nucleic acid codes and reference nucleotide sequences.

Figure 21:
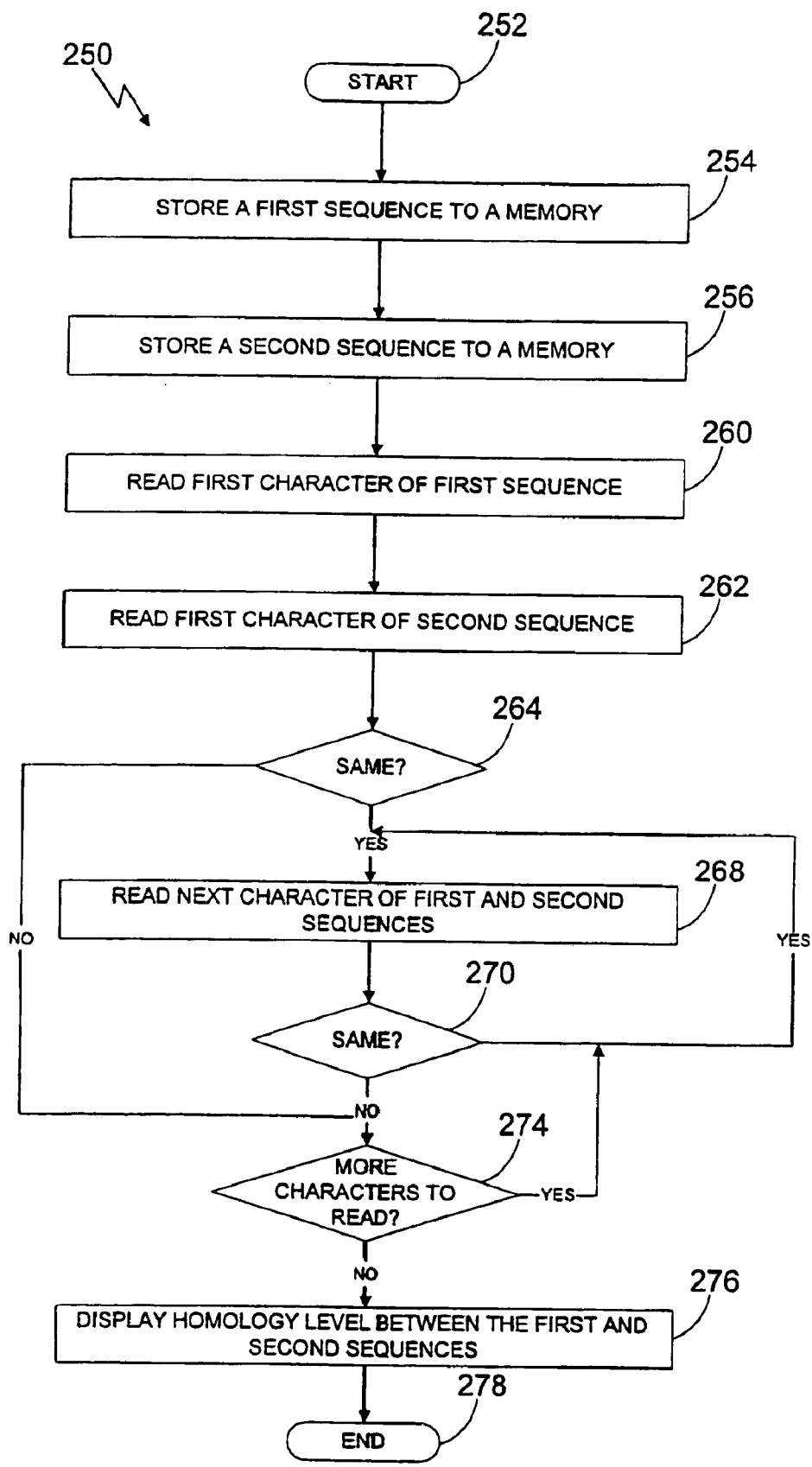
FIG. 21 is a flow diagram illustrating one embodiment of a process 250 in a computer for determining whether two sequences are homologous.

FIG. 21 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there aren't any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the nucleic acid codes of the present invention, to reference nucleotide sequences in order to determine whether the nucleic acid code of SEQ ID Nos. 1 to 26, 36 to 40 and 54 to 229 differs from a reference nucleic acid sequence at one or more positions. Optionally such a program records the length and identity of inserted, deleted or substituted nucleotides with respect to the sequence of either the reference polynucleotide or the nucleic acid code of SEQ ID Nos. 1 to 26, 36 to 40 and 54 to 229. In one embodiment, the computer program may be a program which determines whether the nucleotide sequences of the nucleic acid codes of SEQ ID Nos. 1 to 26, 36 to 40 and 54 to 229 contain a biallelic marker or single nucleotide polymorphism (SNP) with respect to a reference nucleotide sequence. This single nucleotide polymorphism may comprise a single base substitution, insertion, or deletion, while this biallelic marker may comprise about one to ten consecutive bases substituted, inserted or deleted.

Another aspect of the present invention is a method for determining the level of homology between a polypeptide code of SEQ ID Nos. 27 to 35 and 41 to 43 and a reference polypeptide sequence, comprising the steps of reading the polypeptide code of SEQ ID Nos. 27 to 35 and 41 to 43 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of SEQ ID Nos. 1 to 26, 36 to 40 and 54 to 229 differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above and the method illustrated in FIG. 21. The method may also be performed by reading at least 2, 5, 10, 15, 20, 25, 30, or 50 of the nucleic acid codes of SEQ ID Nos. 1 to 26, 36 to 40 and 54 to 229 and the reference nucleotide sequences through the use of the computer program and identifying differences between the nucleic acid codes and the reference nucleotide sequences with the computer program.

In other embodiments the computer based system may further comprise an identifier for identifying features within the nucleotide sequences of the nucleic acid codes of SEQ ID Nos. 1 to 26, 36 to 40 and 54 to 229 or the amino acid sequences of the polypeptide codes of SEQ ID Nos. 27 to 35 and 41 to 43.

An "identifier" refers to one or more programs which identifies certain features within the above-described nucleotide sequences of the nucleic acid codes of SEQ ID Nos. 1 to 26, 36 to 40 and 54 to 229 or the amino acid sequences of the polypeptide codes of SEQ ID Nos. 27 to 35 and 41 to 43. In one embodiment, the identifier may comprise a program which identifies an open reading frame in the cDNAs codes of SEQ ID Nos 2 to 26 and 36 to 40.

Figure 22:
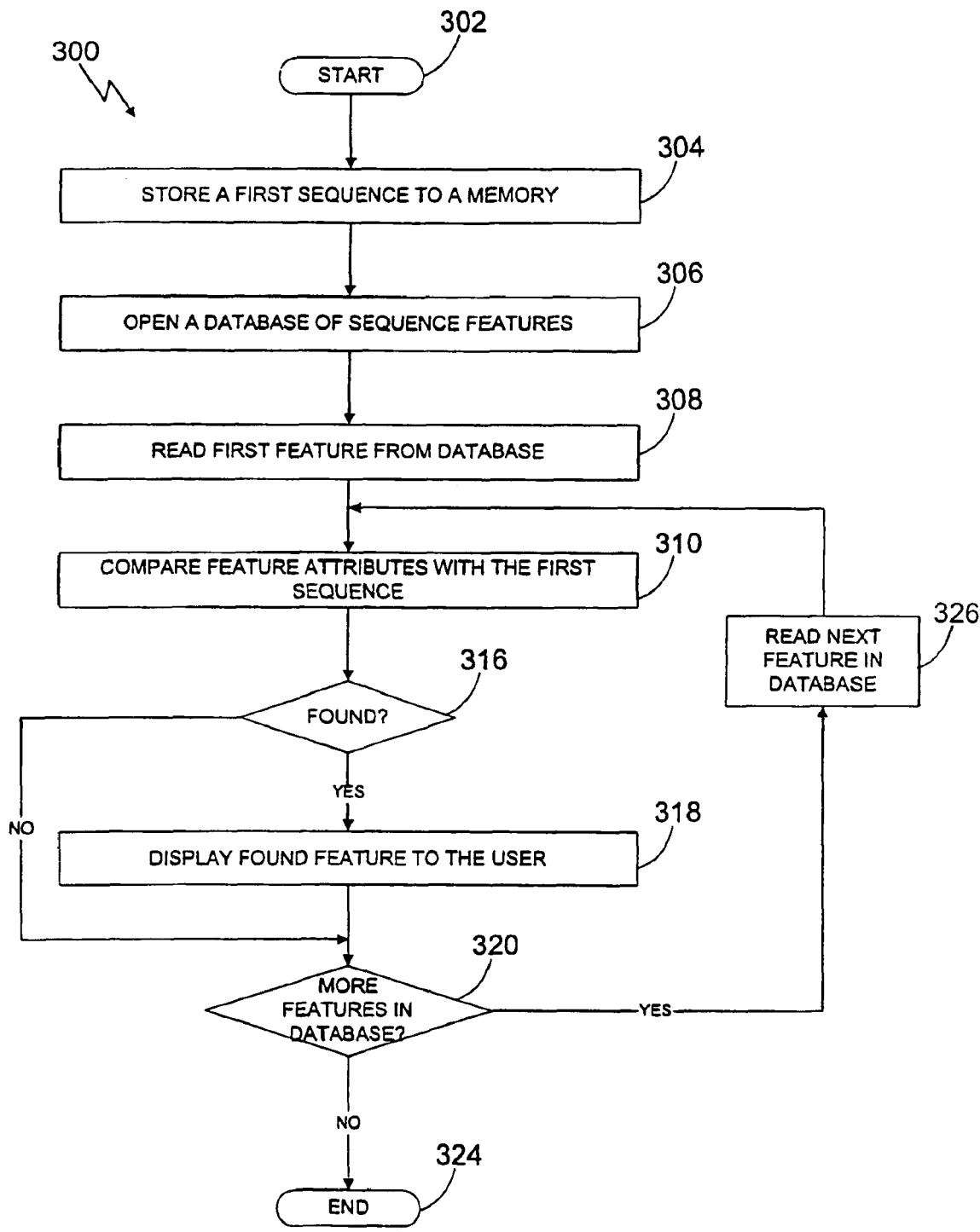
FIG. 22 is a flow diagram illustrating one embodiment of an identifier process 300 for detecting the presence of a feature in a sequence.

FIG. 22 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (www.gcg.com).

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

In another embodiment, the identifier may comprise a molecular modeling program which determines the 3-dimensional structure of the polypeptides codes of SEQ ID Nos. 27 to 35 and 41 to 43. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID Nos. 27 to 35 and 41 to 43. (See e.g., Srinivasan, et al., U.S. Pat. No. 5,557,535 issued Sep. 17, 1996). Conventional homology modeling techniques have been used routinely to build models of proteases and antibodies. (Sowdhamini et al., Protein Engineering 10:207, 215 (1997)). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszódi et al., Proteins:Structure, Function, and Genetics, Supplement 1:38–42 (1997)).

The results of the molecular modeling analysis may then be used in rational drug design techniques to identify agents which modulate the activity of the polypeptide codes of SEQ ID Nos. 27 to 35 and 41 to 43.

Accordingly, another aspect of the present invention is a method of identifying a feature within the nucleic acid codes of SEQ ID Nos. 1 to 26, 36 to 40 and 54 to 229 or the polypeptide codes of SEQ ID Nos. 27 to 35 and 41 to 43 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the nucleic acid codes of SEQ ID Nos. 1 to 26, 36 to 40 and 54 to 229 or the polypeptide codes of SEQ ID Nos. 27 to 35 and 41 to 43 through the use of the computer program and identifying features within the nucleic acid codes or polypeptide codes with the computer program.

The nucleic acid codes of SEQ ID Nos. 1 to 26, 36 to 40 and 54 to 229 or the polypeptide codes of SEQ ID Nos. 27 to 35 and 41 to 43 may be stored and manipulated in a variety of data processor programs in a variety of formats. For example, the nucleic acid codes of SEQ ID Nos. 1 to 26, 36 to 40 and 54 to 229 or the polypeptide codes of SEQ ID Nos. 27 to 35 and 41 to 43 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of SEQ ID Nos. 1 to 26, 36 to 40 and 54 to 229 or the polypeptide codes of SEQ ID Nos. 27 to 35 and 41 to 43. The following list is intended not to limit the invention but to provide guidance to programs and databases which are useful with the nucleic acid codes of SEQ ID Nos. 1 to 26, 36 to 40 and 54 to 229 or the polypeptide codes of SEQ ID Nos. 27 to 35 and 41 to 43. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403 (1990)), FASTA (Pearson and Lipman, Proc. Natl. Acad. Sci. USA, 85: 2444(1988)), FASTDB (Brutlag et al. Comp. App. Biosci. 6:237–245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Throughout this application, various publications, patents, and published patent applications are cited. The disclosures of the publications, patents, and published patent specifications referenced in this application are hereby incorporated by reference into the present disclosure to more fully describe the state of the art to which this invention pertains.

EXAMPLES

Several of the methods of the present invention are described in the following examples, which are offered by way of illustration and not by way of limitation. Many other modifications and variations of the invention as herein set forth can be made without departing from the spirit and scope thereof and therefore only such limitations should be imposed as are indicated by the appended claims.

Example 1

Identification of Biallelic Markers—DNA Extraction

Donors were unrelated and healthy. They presented a sufficient diversity for being representative of a heterogeneous population. The DNA from 100 individuals was extracted and tested for the detection of the biallelic markers.

30 ml of peripheral venous blood were taken from each donor in the presence of EDTA. Cells (pellet) were collected after centrifugation for 10 minutes at 2000 rpm. Red cells were lysed by a lysis solution (50 ml final volume: 10 mM Tris pH7.6; 5 mM $MgCl_2$; 10 mM NaCl). The solution was centrifuged (10 minutes, 2000 rpm) as many times as necessary to eliminate the residual red cells present in the supernatant, after resuspension of the pellet in the lysis solution.

The pellet of white cells was lysed overnight at 42° C. with 3.7 ml of lysis solution composed of:

3 ml TE 10-2 (Tris-HCl 10 mM, EDTA 2 mM)/NaCl 0 4 M

200 µl SDS 10%

500 µl K-proteinase (2 mg K-proteinase in TE 10-2/NaCl 0.4 M).

For the extraction of proteins, 1 ml saturated NaCl (6M) (1/3.5 v/v) was added. After vigorous agitation, the solution was centrifuged for 20 minutes at 10000 rpm.

For the precipitation of DNA, 2 to 3 volumes of 100% ethanol were added to the previous supernatant, and the solution was centrifuged for 30 minutes at 2000 rpm. The DNA solution was rinsed three times with 70% ethanol to eliminate salts, and centrifuged for 20 minutes at 2000 rpm. The pellet was dried at 37° C., and resuspended in 1 ml TE 10-1 or 1 ml water. The DNA concentration was evaluated by measuring the OD at 260 nm (1 unit OD=50 μg/ml DNA). To determine the presence of proteins in the DNA solution, the OD 260/OD 280 ratio was determined. Only DNA preparations having a OD 260/OD 280 ratio between 1.8 and 2 were used in the subsequent examples described below.

The pool was constituted by mixing equivalent quantities of DNA from each individual.

Example 2

Identification of Biallelic Markers: Amplification of Genomic DNA by PCR

The amplification of specific genomic sequences of the DNA samples of Example 1 was carried out on the pool of DNA obtained previously. In addition, 50 individual samples were similarly amplified.

PCR assays were performed using the following protocol:

| | |
|---|---|
| Final volume | 25 μl |
| DNA | 2 ng/μl |
| MgCl$_2$ | 2 mM |
| dNTP (each) | 200 μM |
| primer (each) | 2.9 ng/μl |
| Ampli Taq Gold DNA polymerase | 0.05 unit/μl |
| PCR buffer (10x = 0.1M TrisHCl pH 8.3 0.5M KCl) | 1x |

Each pair of first primers was designed using the sequence information of genomic DNA sequences of SEQ ID Nos 1 to 26, 36 to 40 and 54 to 229 disclosed herein and the OSP software (Hillier & Green, 1991). This first pair of primers was about 20 nucleotides in length and had the sequences disclosed in Table 6a in the columns labeled "Position range of amplification primer in SEQ ID No." and "Complementary position range of amplification primer in SEQ ID No.".

TABLE 6a

| Amplicon | SEQ ID No | Primer name | Position range of amplification primer in SEQ ID | Primer name | Complementary position range of amplification primer in SEQ ID |
|---|---|---|---|---|---|
| 99-27943 | 1 | B1 | 7938 7958 | C1 | 8446 8465 |
| 8-121 | 1 | B2 | 14699 14718 | C2 | 15100 15118 |
| 99-27935 | 1 | B3 | 21365 21385 | C3 | 21845 21864 |
| 8-122 | 1 | B4 | 25409 25426 | C4 | 25825 25844 |
| 8-123 | 1 | B5 | 29349 29366 | C5 | 29684 29701 |
| 8-147 | 1 | B6 | 29900 29919 | C6 | 30340 30356 |
| 99-34243 | 1 | B7 | 49219 49239 | C7 | 49664 49684 |
| 8-127 | 1 | B8 | 64639 64657 | C8 | 64981 64999 |
| 8-128 | 1 | B9 | 65453 65471 | C9 | 65856 65874 |
| 8-129 | 1 | B10 | 65547 65566 | C10 | 65949 65966 |
| 99-34240 | 1 | B11 | 75629 75649 | C11 | 76140 76158 |
| 99-31959 | 1 | B12 | 94254 94273 | C12 | 94683 94703 |
| 99-31960 | 1 | B13 | 95034 95053 | C13 | 95543 95563 |
| 99-31962 | 1 | B14 | 96707 96727 | C14 | 97222 97242 |
| 99-44282 | 1 | B15 | 106357 106377 | C15 | 106805 106822 |
| 99-24656 | 1 | B16 | 107022 107040 | C16 | 107495 107513 |
| 99-24636 | 1 | B17 | 107132 107152 | C17 | 107613 107630 |
| 99-31939 | 1 | B18 | 108425 108444 | C18 | 108916 108935 |
| 99-44281 | 1 | B19 | 109333 109353 | C19 | 109848 109868 |
| 99-31941 | 1 | B20 | 112149 112169 | C20 | 112720 112740 |
| 99-31942 | 1 | B21 | 115144 115162 | C21 | 115617 115637 |
| 99-24635 | 1 | B22 | 155353 155373 | C22 | 155805 155822 |

TABLE 6a-continued

| Amplicon | SEQ ID No | Primer name | Position range of amplification primer in SEQ ID | Primer name | Complementary position range of amplification primer in SEQ ID |
|---|---|---|---|---|---|
| 99-16059 | 1 | B23 | 157860 157878 | C23 | 158296 158316 |
| 99-24634 | 1 | B24 | 160770 160787 | C24 | 161240 161257 |
| 99-24639 | 1 | B25 | 160279 160298 | C25 | 160785 160802 |
| 99-7652 | 1 | B26 | 168813 168830 | C26 | 169331 169351 |
| 99-16100 | 1 | B27 | 170666 170686 | C27 | 171153 171173 |
| 99-5862 | 1 | B28 | 173065 173085 | C28 | 173495 173514 |
| 99-16083 | 1 | B29 | 173830 173850 | C29 | 174309 174327 |
| 99-16044 | 1 | B30 | 175453 175470 | C30 | 175881 175901 |
| 99-16042 | 1 | B31 | 180464 180481 | C31 | 180991 181008 |
| 99-5919 | 1 | B32 | 189753 189771 | C32 | 190187 190207 |
| 99-24658 | 1 | B33 | 197116 197135 | C33 | 197555 197572 |
| 99-30364 | 1 | B34 | 198666 198684 | C34 | 199148 199168 |
| 99-30366 | 1 | B35 | 200145 200162 | C35 | 200663 200683 |
| 99-16094 | 1 | B36 | 204263 204282 | C36 | 204643 204662 |
| 99-24644 | 1 | B37 | 204741 204758 | C37 | 205222 205240 |
| 99-16107 | 1 | B38 | 206103 206120 | C38 | 206548 206568 |
| 99-15873 | 1 | B39 | 211454 211471 | C39 | 211893 211910 |
| 8-124 | 1 | B40 | 214564 214581 | C40 | 214965 214983 |
| 8-125 | 1 | B41 | 215506 215525 | C41 | 215924 215942 |
| 8-132 | 1 | B42 | 215628 215647 | C42 | 215998 216016 |
| 99-13929 | 1 | B43 | 215749 215769 | C43 | 216210 216228 |
| 8-131 | 1 | B44 | 216473 216491 | C44 | 216883 216900 |
| 8-130 | 1 | B45 | 216683 216702 | C45 | 217091 217109 |
| 8-209 | 1 | B46 | 217119 217136 | C46 | 217521 217539 |
| 99-5897 | 1 | B47 | 219408 219425 | C47 | 219882 219899 |
| 99-24649 | 1 | B48 | 220505 220522 | C48 | 221004 221021 |
| 8-199 | 1 | B49 | 221384 221402 | C49 | 221807 221824 |
| 8-198 | 1 | B50 | 221740 221759 | C50 | 222167 222185 |
| 8-195 | 1 | B51 | 222696 222713 | C51 | 223073 223093 |
| 99-13925 | 1 | B52 | 223499 223518 | C52 | 224013 224033 |
| 8-192 | 1 | B53 | 225103 225120 | C53 | 225505 225524 |
| 99-16090 | 1 | B54 | 225995 226013 | C54 | 226510 226530 |
| 8-189 | 1 | B55 | 226211 226230 | C55 | 226615 226632 |
| 8-188 | 1 | B56 | 226569 226588 | C56 | 226988 227005 |
| 8-187 | 1 | B57 | 226915 226934 | C57 | 227319 227338 |
| 8-185 | 1 | B58 | 227468 227487 | C58 | 227888 227907 |
| 99-16051 | 1 | B59 | 227768 227788 | C59 | 228214 228231 |
| 8-184 | 1 | B60 | 227832 227849 | C60 | 228234 228252 |
| 8-183 | 1 | B61 | 228209 228227 | C61 | 228635 228654 |
| 8-181 | 1 | B62 | 228898 228917 | C62 | 229499 229517 |
| 8-180 | 1 | B63 | 229443 229462 | C63 | 229624 229642 |
| 8-179 | 1 | B64 | 229442 229459 | C64 | 229857 229874 |
| 8-143 | 1 | B65 | 229487 229506 | C65 | 229896 229913 |
| 8-178 | 1 | B66 | 229739 229756 | C66 | 230141 230159 |
| 8-177 | 1 | B67 | 230097 230115 | C67 | 230517 230536 |
| 8-119 | 1 | B68 | 230210 230227 | C68 | 230622 230641 |
| 8-138 | 1 | B69 | 230517 230536 | C69 | 230899 230917 |
| 8-175 | 1 | B70 | 230705 230724 | C70 | 231127 231144 |
| 99-15870 | 1 | B71 | 231278 231298 | C71 | 231729 231747 |
| 8-142 | 1 | B72 | 231084 231103 | C72 | 231485 231503 |
| 8-145 | 1 | B73 | 231588 231605 | C73 | 231990 232007 |
| 8-171 | 1 | B74 | 232147 232166 | C74 | 232547 232566 |
| 8-170 | 1 | B75 | 232405 232423 | C75 | 232830 232849 |
| 8-169 | 1 | B76 | 232744 232762 | C76 | 233145 233163 |
| 8-168 | 1 | B77 | 233056 233074 | C77 | 233461 233479 |
| 8-235 | 1 | B78 | 233314 233334 | C78 | 233785 233801 |
| 8-137 | 1 | B79 | 234039 234058 | C79 | 234440 234458 |
| 8-165 | 1 | B80 | 234516 234533 | C80 | 234916 234935 |
| 99-16087 | 1 | B81 | 235081 235101 | C81 | 235515 235533 |
| 8-157 | 1 | B82 | 237972 237989 | C82 | 238381 238399 |
| 8-155 | 1 | B83 | 238607 238626 | C83 | 239029 239046 |
| 99-16038 | 1 | B84 | 239405 239425 | C84 | 239862 239880 |
| 8-136 | 1 | B85 | 239606 239624 | C85 | 240012 240029 |
| 8-153 | 1 | B86 | 239651 239670 | C86 | 240058 240075 |
| 8-135 | 1 | B87 | 240356 240375 | C87 | 240691 240708 |
| 99-16050 | 1 | B88 | 240518 240538 | C88 | 240988 241006 |
| 8-144 | 1 | B89 | 240810 240828 | C89 | 241217 241235 |
| 8-141 | 1 | B90 | 241094 241113 | C90 | 241502 241520 |
| 99-15880 | 1 | B91 | 241700 241717 | C91 | 242151 242171 |
| 8-140 | 1 | B92 | 241373 241392 | C92 | 241773 241792 |
| 8-240 | 1 | B93 | 242169 242188 | C93 | 242571 242588 |
| 8-225 | 1 | B94 | 244172 244191 | C94 | 244574 244593 |
| 99-25940 | 1 | B95 | 247513 247533 | C95 | 248023 248043 |

TABLE 6a-continued

| Amplicon | SEQ ID No | Primer name | Position range of amplification primer in SEQ ID | | Primer name | Complementary position range of amplification primer in SEQ ID | |
|---|---|---|---|---|---|---|---|
| 99-16032 | 1 | B96 | 248204 | 248223 | C96 | 248588 | 248606 |
| 99-16055 | 1 | B97 | 253315 | 253333 | C97 | 253816 | 253834 |
| 99-16105 | 1 | B98 | 255697 | 255715 | C98 | 256133 | 256152 |
| 99-16101 | 1 | B99 | 258138 | 258155 | C99 | 258606 | 258623 |
| 99-16033 | 1 | B100 | 259885 | 259902 | C100 | 260324 | 260342 |
| 99-15875 | 1 | B101 | 279626 | 279644 | C101 | 280154 | 280173 |
| 99-13521 | 1 | B102 | 287977 | 287995 | C102 | 288484 | 288504 |
| 8-112 | 1 | B103 | 292501 | 292519 | C103 | 292901 | 292920 |
| 8-111 | 1 | B104 | 295376 | 295395 | C104 | 295777 | 295795 |
| 8-110 | 1 | B105 | 295682 | 295701 | C105 | 296102 | 296119 |
| 8-134 | 1 | B106 | 295812 | 295830 | C106 | 296143 | 296161 |
| 99-7462 | 1 | B107 | 298946 | 298964 | C107 | 299459 | 299476 |
| 99-16052 | 1 | B108 | 300153 | 300170 | C108 | 300660 | 300680 |
| 99-16047 | 1 | B109 | 311615 | 311632 | C109 | 312126 | 312144 |
| 99-25993 | 1 | B110 | 315649 | 315668 | C110 | 316129 | 316147 |
| 99-25101 | 1 | B111 | 316925 | 316943 | C111 | 317378 | 317395 |
| 8-94 | 162 | B112 | 1250 | 1267 | C112 | 1651 | 1669 |
| 8-95 | 161 | B113 | 1125 | 1144 | C113 | 1526 | 1543 |
| 8-97 | 160 | B114 | 1249 | 1268 | C114 | 1581 | 1598 |
| 8-98 | 159 | B115 | 1135 | 1154 | C115 | 1550 | 1568 |
| 99-14021 | 151 | B116 | 1394 | 1411 | C116 | 1853 | 1870 |
| 99-14364 | 152 | B117 | 1344 | 1364 | C117 | 1798 | 1816 |
| 99-15056 | 115 | B118 | 1098 | 1118 | C118 | 1582 | 1599 |
| 99-15063 | 116 | B119 | 1347 | 1364 | C119 | 1784 | 1804 |
| 99-15065 | 117 | B120 | 1120 | 1140 | C120 | 1568 | 1585 |
| 99-15229 | 157 | B121 | 1419 | 1437 | C121 | 1893 | 1912 |
| 99-15231 | 163 | B122 | 1189 | 1209 | C122 | 1701 | 1719 |
| 99-15232 | 155 | B123 | 1211 | 1228 | C123 | 1677 | 1695 |
| 99-15239 | 164 | B124 | 1139 | 1156 | C124 | 1579 | 1599 |
| 99-15252 | 118 | B125 | 1 | 18 | C125 | 434 | 451 |
| 99-15253 | 119 | B126 | 1120 | 1138 | C126 | 1578 | 1596 |
| 99-15256 | 120 | B127 | 1110 | 1127 | C127 | 1548 | 1565 |
| 99-15258 | 121 | B128 | 1165 | 1183 | C128 | 1685 | 1705 |
| 99-15261 | 122 | B129 | 1302 | 1320 | C129 | 1782 | 1802 |
| 99-15280 | 123 | B130 | 1070 | 1087 | C130 | 1590 | 1610 |
| 99-15355 | 124 | B131 | 1352 | 1369 | C131 | 1822 | 1840 |
| 99-15663 | 175 | B132 | 1349 | 1369 | C132 | 1781 | 1798 |
| 99-15664 | 176 | B133 | 1184 | 1203 | C133 | 1667 | 1685 |
| 99-15665 | 174 | B134 | 1423 | 1441 | C134 | 1879 | 1898 |
| 99-15668 | 177 | B135 | 1363 | 1380 | C135 | 1801 | 1821 |
| 99-15672 | 173 | B136 | 1120 | 1138 | C136 | 1649 | 1666 |
| 99-15682 | 178 | B137 | 1184 | 1202 | C137 | 1665 | 1683 |
| 99-16081 | 113 | B138 | 114 | 131 | C138 | 556 | 575 |
| 99-16082 | 114 | B139 | 16 | 33 | C139 | 527 | 547 |
| 99-20933 | 179 | B140 | 1130 | 1149 | C140 | 1563 | 1581 |
| 99-20977 | 147 | B141 | 1430 | 1447 | C141 | 1921 | 1941 |
| 99-20978 | 148 | B142 | 1124 | 1144 | C142 | 1571 | 1589 |
| 99-20981 | 149 | B143 | 1202 | 1219 | C143 | 1630 | 1650 |
| 99-20983 | 150 | B144 | 1099 | 1119 | C144 | 1530 | 1548 |
| 99-22310 | 154 | B145 | 1183 | 1203 | C145 | 1630 | 1648 |
| 99-25029 | 180 | B146 | 1292 | 1307 | C146 | 1722 | 1741 |
| 99-25224 | 125 | B147 | 937 | 955 | C147 | 1446 | 1466 |
| 99-25869 | 181 | B148 | 1320 | 1340 | C148 | 1849 | 1868 |
| 99-25881 | 182 | B149 | 1227 | 1245 | C149 | 1693 | 1713 |
| 99-25897 | 183 | B150 | 1242 | 1262 | C150 | 1736 | 1756 |
| 99-25906 | 184 | B151 | 1374 | 1392 | C151 | 1888 | 1908 |
| 99-25917 | 185 | B152 | 1115 | 1135 | C152 | 1595 | 1615 |
| 99-25924 | 186 | B153 | 1287 | 1306 | C153 | 1717 | 1736 |
| 99-25950 | 126 | B154 | 1381 | 1399 | C154 | 1859 | 1879 |
| 99-25961 | 127 | B155 | 1391 | 1411 | C155 | 1854 | 1873 |
| 99-25965 | 128 | B156 | 1429 | 1449 | C156 | 1879 | 1899 |
| 99-25966 | 129 | B157 | 1219 | 1239 | C157 | 1721 | 1741 |
| 99-25967 | 130 | B158 | 1064 | 1084 | C158 | 1537 | 1556 |
| 99-25969 | 131 | B159 | 1171 | 1191 | C159 | 1680 | 1700 |
| 99-25972 | 132 | B160 | 1368 | 1388 | C160 | 1795 | 1815 |
| 99-25974 | 133 | B161 | 1100 | 1120 | C161 | 1623 | 1643 |
| 99-25977 | 134 | B162 | 1191 | 1211 | C162 | 1710 | 1730 |
| 99-25978 | 135 | B163 | 1155 | 1175 | C163 | 1644 | 1663 |
| 99-25979 | 136 | B164 | 1409 | 1427 | C164 | 1924 | 1944 |
| 99-25980 | 137 | B165 | 1332 | 1352 | C165 | 1817 | 1837 |
| 99-25984 | 138 | B166 | 1293 | 1310 | C166 | 1794 | 1812 |
| 99-25985 | 139 | B167 | 1308 | 1328 | C167 | 1756 | 1776 |
| 99-25989 | 140 | B168 | 1346 | 1366 | C168 | 1880 | 1898 |
| 99-26126 | 165 | B169 | 1004 | 1022 | C169 | 1525 | 1545 |
| 99-26138 | 187 | B170 | 1309 | 1327 | C170 | 1741 | 1761 |
| 99-26146 | 188 | B171 | 1314 | 1334 | C171 | 1746 | 1764 |
| 99-26147 | 141 | B172 | 1433 | 1453 | C172 | 1879 | 1896 |
| 99-26150 | 142 | B173 | 1323 | 1340 | C173 | 1758 | 1776 |
| 99-26153 | 143 | B174 | 1458 | 1476 | C174 | 1885 | 1905 |
| 99-26154 | 144 | B175 | 1396 | 1415 | C175 | 1903 | 1920 |
| 99-26156 | 145 | B176 | 1212 | 1229 | C176 | 1702 | 1722 |
| 99-26166 | 166 | B177 | 1237 | 1257 | C177 | 1739 | 1757 |
| 99-26167 | 167 | B178 | 1319 | 1339 | C178 | 1759 | 1778 |
| 99-26169 | 168 | B179 | 1262 | 1282 | C179 | 1693 | 1711 |
| 99-26171 | 169 | B180 | 1431 | 1450 | C180 | 1860 | 1880 |
| 99-26183 | 170 | B181 | 1348 | 1367 | C181 | 1798 | 1818 |
| 99-26189 | 189 | B182 | 1215 | 1235 | C182 | 1644 | 1664 |
| 99-26190 | 190 | B183 | 1071 | 1091 | C183 | 1502 | 1520 |
| 99-26191 | 191 | B184 | 1095 | 1115 | C184 | 1539 | 1558 |
| 99-26201 | 192 | B185 | 1304 | 1324 | C185 | 1749 | 1767 |
| 99-26222 | 193 | B186 | 1354 | 1373 | C186 | 1843 | 1863 |
| 99-26223 | 194 | B187 | 1277 | 1297 | C187 | 1842 | 1862 |
| 99-26225 | 195 | B188 | 1355 | 1375 | C188 | 1805 | 1825 |
| 99-26228 | 196 | B189 | 1330 | 1350 | C189 | 1792 | 1812 |
| 99-26233 | 197 | B190 | 1254 | 1274 | C190 | 1755 | 1775 |
| 99-26234 | 198 | B191 | 1379 | 1399 | C191 | 1813 | 1833 |
| 99-26238 | 199 | B192 | 1235 | 1255 | C192 | 1668 | 1686 |
| 99-5873 | 146 | B193 | 1176 | 1194 | C193 | 1632 | 1649 |
| 99-5912 | 171 | B194 | 1463 | 1483 | C194 | 1946 | 1963 |
| 99-6012 | 158 | B195 | 1292 | 1310 | C195 | 1758 | 1776 |
| 99-6080 | 156 | B196 | 1061 | 1081 | C196 | 1572 | 1589 |
| 99-7308 | 153 | B197 | 1345 | 1362 | C197 | 1814 | 1834 |
| 99-7337 | 172 | B198 | 1298 | 1318 | C198 | 1731 | 1748 |
| 99-16106 | 200 | B199 | 32 | 50 | C199 | 518 | 535 |
| 99-25332 | 201 | B200 | 1 | 18 | C200 | 461 | 478 |
| 99-25516 | 202 | B201 | 1 | 18 | C201 | 385 | 404 |
| 99-26173 | 203 | B202 | 1033 | 1052 | C202 | 1570 | 1589 |
| 99-26267 | 204 | B203 | 983 | 1002 | C203 | 1553 | 1573 |
| 99-26284 | 205 | B204 | 1460 | 1480 | C204 | 1874 | 1894 |
| 99-26559 | 206 | B205 | 1187 | 1207 | C205 | 1650 | 1670 |
| 99-26769 | 207 | B206 | 1249 | 1267 | C206 | 1707 | 1727 |
| 99-26772 | 208 | B207 | 1235 | 1254 | C207 | 1702 | 1722 |
| 99-26776 | 209 | B208 | 1294 | 1314 | C208 | 1755 | 1775 |
| 99-26779 | 210 | B209 | 1072 | 1089 | C209 | 1548 | 1568 |
| 99-26781 | 211 | B210 | 1477 | 1497 | C210 | 1905 | 1925 |
| 99-26782 | 212 | B211 | 1202 | 1221 | C211 | 1695 | 1715 |
| 99-26783 | 213 | B212 | 1421 | 1440 | C212 | 1857 | 1877 |
| 99-26787 | 214 | B213 | 1406 | 1425 | C213 | 1872 | 1892 |
| 99-26789 | 215 | B214 | 1301 | 1319 | C214 | 1771 | 1791 |
| 99-27297 | 216 | B215 | 1206 | 1224 | C215 | 1761 | 1779 |
| 99-27306 | 217 | B216 | 1395 | 1415 | C216 | 1822 | 1842 |
| 99-27312 | 218 | B217 | 1445 | 1463 | C217 | 1940 | 1960 |
| 99-27323 | 219 | B218 | 1132 | 1150 | C218 | 1610 | 1628 |
| 99-27335 | 220 | B219 | 1322 | 1342 | C219 | 1768 | 1788 |
| 99-27345 | 221 | B220 | 1139 | 1159 | C220 | 1672 | 1689 |
| 99-27349 | 222 | B221 | 1337 | 1355 | C221 | 1748 | 1767 |
| 99-27352 | 223 | B222 | 1250 | 1269 | C222 | 1677 | 1697 |
| 99-27353 | 224 | B223 | 1085 | 1105 | C223 | 1584 | 1604 |
| 99-27360 | 225 | B224 | 1361 | 1381 | C224 | 1793 | 1812 |
| 99-27361 | 226 | B225 | 1322 | 1340 | C225 | 1815 | 1834 |
| 99-27365 | 227 | B226 | 1081 | 1099 | C226 | 1590 | 1609 |
| 99-27680 | 228 | B227 | 1 | 18 | C227 | 509 | 526 |
| 99-27912 | 229 | B228 | 1230 | 1250 | C228 | 1659 | 1679 |
| 99-30329 | 112 | B229 | 1 | 18 | C229 | 496 | 514 |

Preferably, the primers contained a common oligonucleotide tail upstream of the specific bases targeted for amplification which was useful for sequencing.

Primers from the column labeled "Position range of amplification primer in SEQ ID No." contain the following additional PU 5' sequence: TGTAAAACGACGGCCAGT (SEQ ID No. 230); primers from the column labeled "Complementary position range of amplification primer in SEQ ID No." contain the following RP 5' sequence: CAGGAAACAGCTATGACC (SEQ ID No. 231).

The synthesis of these primers was performed following the phosphoramidite method, on a GENSET UFPS 24.1 synthesizer.

DNA amplification was performed on a Genius II thermocycler. After heating at 95° C. for 10 min, 40 cycles were performed. Each cycle comprised: 30 sec at 95° C., 54° C. for 1 min, and 30 sec at 72° C. For final elongation, 10 min at 72° C. ended the amplification. The quantities of the amplification products obtained were determined on 96-well microtiter plates, using a fluorometer and Picogreen as intercalant agent (Molecular Probes).

Example 3

Identification of Polymorphisms a) Identification of Biallelic Markers from Amplified Genomic DNA of Example 2

The sequencing of the amplified DNA obtained in Example 2 was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were determined using gel image analysis (ABI Prism DNA Sequencing Analysis software (2.1.2 version)).

The sequence data were further evaluated to detect the presence of biallelic markers within the amplified fragments. The polymorphism search was based on the presence of superimposed peaks in the electrophoresis pattern resulting from different bases occurring at the same position as described previously.

The localization of the biallelic markers detected in the fragments of amplification are as shown below in Table 6b.

TABLE 6b

Biallelic Markers

| Amplicon | BM | Marker Name | Polymorphism All1 | All2 | SEQ ID No. | BM position in SEQ ID | Position of probes in SEQ ID No. | Probes |
|---|---|---|---|---|---|---|---|---|
| 99-27943 | A1 | 99-27943-150 | G | C | 1 | 8316 | 8304 8328 | P1 |
| 8-121 | A2 | 8-121-28 | A | T | 1 | 14726 | 14714 14738 | P2 |
| 8-121 | A3 | 8-121-36 | C | T | 1 | 14734 | 14722 14746 | P3 |
| 8-121 | A4 | 8-121-154 | A | T | 1 | 14852 | 14840 14864 | P4 |
| 8-121 | A5 | 8-121-187 | A | C | 1 | 14885 | 14873 14897 | P5 |
| 8-121 | A6 | 8-121-243 | G | T | 1 | 14941 | 14929 14953 | P6 |
| 8-121 | A7 | 8-121-281 | A | C | 1 | 14979 | 14967 14991 | P7 |
| 8-121 | A8 | 8-121-352 | C | T | 1 | 15050 | 15038 15062 | P8 |
| 8-121 | A9 | 8-121-364 | C | T | 1 | 15062 | 15050 15074 | P9 |
| 8-121 | A10 | 8-121-371 | A | G | 1 | 15069 | 15057 15081 | P10 |
| 99-27935 | A11 | 99-27935-193 | G | C | 1 | 21672 | 21660 21684 | P11 |
| 8-122 | A12 | 8-122-72 | A | T | 1 | 25480 | 25468 25492 | P12 |
| 8-122 | A13 | 8-122-100 | C | T | 1 | 25508 | 25496 25520 | P13 |
| 8-122 | A14 | 8-122-271 | deletion of CAAA | | 1 | 25679 | 25667 25691 | P14 |
| 8-122 | A15 | 8-122-272 | A | A | 1 | 25680 | 25668 25692 | P15 |
| 8-122 | A16 | 8-122-326 | A | A | 1 | 25734 | 25722 25746 | P16 |
| 8-122 | A17 | 8-122-360 | C | C | 1 | 25768 | 25756 25780 | P17 |
| 8-123 | A18 | 8-123-55 | A | A | 1 | 29403 | 29391 29415 | P18 |
| 8-123 | A19 | 8-123-189 | C | C | 1 | 29537 | 29525 29549 | P19 |
| 8-123 | A20 | 8-123-197 | C | C | 1 | 29545 | 29533 29557 | P20 |
| 8-123 | A21 | 8-123-307 | G | G | 1 | 29655 | 29643 29667 | P21 |
| 8-147 | A22 | 8-147-270 | A | A | 1 | 30169 | 30157 30181 | P22 |
| 99-34243 | A23 | 99-34243-210 | A | A | 1 | 49475 | 49463 49487 | P23 |
| 8-127 | A24 | 8-127-28 | A | A | 1 | 64666 | 64654 64678 | P24 |
| 8-127 | A25 | 8-127-119 | A | A | 1 | 64757 | 64745 64769 | P25 |
| 8-127 | A26 | 8-127-159 | A | A | 1 | 64797 | 64785 64809 | P26 |
| 8-127 | A27 | 8-127-236 | C | C | 1 | 64874 | 64862 64886 | P27 |
| 8-127 | A28 | 8-127-240 | A | A | 1 | 64878 | 64866 64890 | P28 |
| 8-127 | A29 | 8-127-280 | G | G | 1 | 64918 | 64906 64930 | P29 |
| 8-128 | A30 | 8-128-33 | C | C | 1 | 65485 | 65473 65497 | P30 |
| 8-128 | A31 | 8-128-52 | A | A | 1 | 65504 | 65492 65516 | P31 |
| 8-128 | A32 | 8-128-61 | G | G | 1 | 65513 | 65501 65525 | P32 |
| 8-128 | A33 | 8-128-68 | C | C | 1 | 65520 | 65508 65532 | P33 |
| 8-128 | A34 | 8-128-69 | A | A | 1 | 65521 | 65509 65533 | P34 |
| 8-128 | A35 | 8-128-85 | A | A | 1 | 65537 | 65525 65549 | P35 |
| 8-129 | A36 | 8-129-50 | C | C | 1 | 65596 | 65584 65608 | P36 |
| 8-129 | A37 | 8-129-60 | deletion of A | | 1 | 65607 | 65594 65618 | P37 |
| 8-129 | A38 | 8-129-311 | A | G | 1 | 65857 | 65845 65869 | P38 |
| 8-129 | A39 | 8-129-401 | C | T | 1 | 65947 | 65935 65959 | P39 |
| 99-34240 | A40 | 99-34240-492 | A | T | 1 | 75667 | 75655 75679 | P40 |
| 99-31959 | A41 | 99-31959-281 | C | T | 1 | 94534 | 94522 94546 | P41 |
| 99-31960 | A42 | 99-31960-363 | A | G | 1 | 95396 | 95384 95408 | P42 |
| 99-31962 | A43 | 99-31962-250 | C | T | 1 | 96956 | 96944 96968 | P43 |
| 99-31962 | A44 | 99-31962-450 | A | G | 1 | 97156 | 97144 97168 | P44 |
| 99-44282 | A45 | 99-44282-439 | A | G | 1 | 106384 | 106372 106396 | P45 |
| 99-44282 | A46 | 99-44282-54 | C | T | 1 | 106769 | 106757 106781 | P46 |
| 99-24656 | A47 | 99-24656-137 | A | G | 1 | 107158 | 107146 107170 | P47 |
| 99-24656 | A48 | 99-24656-260 | A | G | 1 | 107281 | 107269 107293 | P48 |
| 99-24636 | A49 | 99-24636-22 | A | G | 1 | 107609 | 107597 107621 | P49 |

TABLE 6b-continued

Biallelic Markers

| | | | | | | | | | |
|---|---|---|---|---|---|---|---|---|---|
| 99-31939 | A50 | 99-31939-75 | A | G | 1 | 108499 | 108487 | 108511 | P50 |
| 99-31939 | A51 | 99-31939-273 | C | T | 1 | 108697 | 108685 | 108709 | P51 |
| 99-44281 | A52 | 99-44281-418 | G | T | 1 | 109451 | 109439 | 109463 | P52 |
| 99-44281 | A53 | 99-44281-257 | A | G | 1 | 109612 | 109600 | 109624 | P53 |
| 99-44281 | A54 | 99-44281-77 | A | G | 1 | 109792 | 109780 | 109804 | P54 |
| 99-31941 | A55 | 99-31941-320 | G | T | 1 | 112468 | 112456 | 112480 | P55 |
| 99-31942 | A56 | 99-31942-325 | G | T | 1 | 115468 | 115456 | 115480 | P56 |
| 99-24635 | A57 | 99-24635-79 | A | T | 1 | 155736 | 155724 | 155748 | P57 |
| 99-16059 | A58 | 99-16059-313 | A | G | 1 | 158172 | 158160 | 158184 | P58 |
| 99-24639 | A59 | 99-24639-169 | C | T | 1 | 160634 | 160622 | 160646 | P59 |
| 99-24639 | A60 | 99-24639-163 | A | C | 1 | 160640 | 160628 | 160652 | P60 |
| 99-24634 | A61 | 99-24634-108 | A | T | 1 | 160876 | 160864 | 160888 | P61 |
| 99-7652 | A62 | 99-7652-162 | A | G | 1 | 168974 | 168962 | 168986 | P62 |
| 99-7652 | A63 | 99-7652-488 | A | G | 1 | 169300 | 169288 | 169312 | P63 |
| 99-16100 | A64 | 99-16100-83 | C | T | 1 | 170746 | 170734 | 170758 | P64 |
| 99-16100 | A65 | 99-16100-147 | A | G | 1 | 170810 | 170798 | 170822 | P65 |
| 99-16100 | A66 | 99-16100-195 | G | T | 1 | 170858 | 170846 | 170870 | P66 |
| 99-16100 | A67 | 99-16100-197 | C | T | 1 | 170860 | 170848 | 170872 | P67 |
| 99-16100 | A68 | 99-16100-244 | C | T | 1 | 170906 | 170894 | 170918 | P68 |
| 99-16100 | A69 | 99-16100-381 | A | C | 1 | 171043 | 171031 | 171055 | P69 |
| 99-5862 | A70 | 99-5862-167 | A | G | 1 | 173358 | 173346 | 173370 | P70 |
| 99-16083 | A71 | 99-16083-101 | C | T | 1 | 174227 | 174215 | 174239 | P71 |
| 99-16044 | A72 | 99-16044-351 | C | T | 1 | 175800 | 175788 | 175812 | P72 |
| 99-16042 | A73 | 99-16042-420 | A | G | 1 | 180589 | 180577 | 180601 | P73 |
| 99-16042 | A74 | 99-16042-31 | G | C | 1 | 180978 | 180966 | 180990 | P74 |
| 99-5919 | A75 | 99-5919-215 | A | G | 1 | 189957 | 189945 | 189969 | P75 |
| 99-24658 | A76 | 99-24658-410 | A | G | 1 | 197163 | 197151 | 197175 | P76 |
| 99-30364 | A77 | 99-30364-299 | A | G | 1 | 198964 | 198952 | 198976 | P77 |
| 99-30366 | A78 | 99-30366-112 | G | T | 1 | 200256 | 200244 | 200268 | P78 |
| 99-16094 | A79 | 99-16094-75 | G | T | 1 | 204588 | 204576 | 204600 | P79 |
| 99-24644 | A80 | 99-24644-194 | A | G | 1 | 204934 | 204922 | 204946 | P80 |
| 99-16107 | A81 | 99-16107-95 | A | T | 1 | 206197 | 206185 | 206209 | P81 |
| 99-16107 | A82 | 99-16107-161 | A | G | 1 | 206263 | 206251 | 206275 | P82 |
| 99-16107 | A83 | 99-16107-383 | C | T | 1 | 206485 | 206473 | 206497 | P83 |
| 99-15873 | A84 | 99-15873-303 | C | T | 1 | 211608 | 211596 | 211620 | P84 |
| 8-124 | A85 | 8-124-106 | A | G | 1 | 214669 | 214657 | 214681 | P85 |
| 8-124 | A86 | 8-124-220 | A | G | 1 | 214783 | 214771 | 214795 | P86 |
| 8-124 | A87 | 8-124-294 | A | G | 1 | 214857 | 214845 | 214869 | P87 |
| 8-124 | A88 | 8-124-316 | C | T | 1 | 214879 | 214867 | 214891 | P88 |
| 8-124 | A89 | 8-124-383 | A | T | 1 | 214946 | 214934 | 214958 | P89 |
| 8-125 | A90 | 8-125-33 | C | T | 1 | 215538 | 215526 | 215550 | P90 |
| 8-132 | A91 | 8-132-312 | A | G | 1 | 215705 | 215693 | 215717 | P91 |
| 8-132 | A92 | 8-132-179 | A | T | 1 | 215838 | 215826 | 215850 | P92 |
| 8-132 | A93 | 8-132-164 | A | G | 1 | 215853 | 215841 | 215865 | P93 |
| 8-132 | A94 | 8-132-97 | A | G | 1 | 215920 | 215908 | 215932 | P94 |
| 99-13929 | A95 | 99-13929-201 | G | T | 1 | 216028 | 216016 | 216040 | P95 |
| 8-131 | A96 | 8-131-363 | G | T | 1 | 216538 | 216526 | 216550 | P96 |
| 8-131 | A97 | 8-131-199 | G | T | 1 | 216702 | 216690 | 216714 | P97 |
| 8-130 | A98 | 8-130-236 | C | T | 1 | 216874 | 216862 | 216886 | P98 |
| 8-130 | A99 | 8-130-220 | G | T | 1 | 216890 | 216878 | 216902 | P99 |
| 8-130 | A100 | 8-130-144 | C | T | 1 | 216966 | 216954 | 216978 | P100 |
| 8-130 | A101 | 8-130-143 | A | G | 1 | 216967 | 216955 | 216979 | P101 |
| 8-130 | A102 | 8-130-102 | C | T | 1 | 217008 | 216996 | 217020 | P102 |
| 8-130 | A103 | 8-130-101 | G | T | 1 | 217009 | 216997 | 217021 | P103 |
| 8-130 | A104 | 8-130-83 | A | C | 1 | 217027 | 217015 | 217039 | P104 |
| 8-209 | A105 | 8-209-333 | A | G | 1 | 217207 | 217195 | 217219 | P105 |
| 8-209 | A106 | 8-209-290 | A | C | 1 | 217250 | 217238 | 217262 | P106 |
| 99-5897 | A107 | 99-5897-143 | A | C | 1 | 219540 | 219528 | 219552 | P107 |
| 99-24649 | A108 | 99-24649-186 | A | G | 1 | 220836 | 220824 | 220848 | P108 |
| 99-24649 | A109 | 99-24649-80 | G | C | 1 | 220942 | 220930 | 220954 | P109 |
| 8-199 | A110 | 8-199-84 | G | T | 1 | 221741 | 221729 | 221753 | P110 |
| 8-198 | A111 | 8-198-138 | A | G | 1 | 222048 | 222036 | 222060 | P111 |
| 8-195 | A112 | 8-195-348 | C | T | 1 | 222746 | 222734 | 222758 | P112 |
| 99-13925 | A113 | 99-13925-97 | A | G | 1 | 223595 | 223583 | 223607 | P113 |
| 8-192 | A114 | 8-192-82 | A | G | 1 | 225443 | 225431 | 225455 | P114 |
| 99-16090 | A115 | 99-16090-225 | A | G | 1 | 226219 | 226207 | 226231 | P115 |
| 8-189 | A116 | 8-189-340 | Deletion of CTAT | | 1 | 226282 | 226270 | 2263094 | P116 |
| 8-189 | A117 | 8-189-146 | G | T | 1 | 226487 | 226475 | 226499 | P117 |
| 8-188 | A118 | 8-188-136 | C | T | 1 | 226870 | 226858 | 226882 | P118 |
| 8-187 | A119 | 8-187-352 | G | T | 1 | 226987 | 226975 | 226999 | P119 |
| 8-185 | A120 | 8-185-319 | G | T | 1 | 227589 | 227577 | 227601 | P120 |
| 8-185 | A121 | 8-185-296 | A | T | 1 | 227612 | 227600 | 227624 | P121 |
| 99-16051 | A122 | 99-16051-226 | C | T | 1 | 228006 | 227994 | 228018 | P122 |
| 99-16051 | A123 | 99-16051-164 | A | G | 1 | 228068 | 228056 | 228080 | P123 |
| 8-184 | A124 | 8-184-119 | A | T | 1 | 228134 | 228122 | 228146 | P124 |
| 8-184 | A125 | 8-184-27 | A | C | 1 | 228226 | 228214 | 228238 | P125 |

TABLE 6b-continued

Biallelic Markers

| | | | | | | | | | |
|---|---|---|---|---|---|---|---|---|---|
| 8-183 | A126 | 8-183-401 | C | T | 1 | 228254 | 228242 | 228266 | P126 |
| 8-181 | A127 | 8-181-449 | C | T | 1 | 229069 | 229057 | 229081 | P127 |
| 8-181 | A128 | 8-181-350 | A | T | 1 | 229168 | 229156 | 229180 | P128 |
| 8-181 | A129 | 8-181-259 | A | G | 1 | 229259 | 229247 | 229271 | P129 |
| 8-181 | A130 | 8-181-230 | A | T | 1 | 229288 | 229276 | 229300 | P130 |
| 8-181 | A131 | 8-181-210 | A | T | 1 | 229308 | 229296 | 229320 | P131 |
| 8-181 | A132 | 8-181-165 | C | T | 1 | 229353 | 229341 | 229365 | P132 |
| 8-181 | A133 | 8-181-163 | C | T | 1 | 229355 | 229343 | 229367 | P133 |
| 8-181 | A134 | 8-181-83 | C | T | 1 | 229435 | 229423 | 229447 | P134 |
| 8-180 | A135 | 8-180-157 | A | T | 1 | 229486 | 229474 | 229498 | P135 |
| 8-143 | A136 | 8-143-332 | A | C | 1 | 229582 | 229570 | 229594 | P136 |
| 8-143 | A137 | 8-143-327 | A | G | 1 | 229587 | 229575 | 229599 | P137 |
| 8-143 | A138 | 8-143-311 | A | G | 1 | 229603 | 229591 | 229615 | P138 |
| 8-143 | A139 | 8-143-308 | A | G | 1 | 229606 | 229594 | 229618 | P139 |
| 8-179 | A140 | 8-179-268 | A | C | 1 | 229607 | 229595 | 229619 | P140 |
| 8-143 | A141 | 8-143-306 | A | G | 1 | 229608 | 229596 | 229620 | P141 |
| 8-143 | A142 | 8-143-245 | G | T | 1 | 229669 | 229657 | 229681 | P142 |
| 8-143 | A143 | 8-143-242 | A | G | 1 | 229672 | 229660 | 229684 | P143 |
| 8-143 | A144 | 8-143-239 | C | T | 1 | 229675 | 229663 | 229687 | P144 |
| 8-143 | A145 | 8-143-232 | G | C | 1 | 229682 | 229670 | 229694 | P145 |
| 8-143 | A146 | 8-143-152 | G | C | 1 | 229762 | 229750 | 229774 | P146 |
| 8-178 | A147 | 8-178-199 | G | C | 1 | 229961 | 229949 | 229973 | P147 |
| 8-178 | A148 | 8-178-123 | Deletion of A | | 1 | 230037 | 230025 | 230049 | P148 |
| 8-119 | A149 | 8-119-404 | C | T | 1 | 230238 | 230226 | 230250 | P149 |
| 8-177 | A150 | 8-177-281 | C | T | 1 | 230256 | 230244 | 230268 | P150 |
| 8-119 | A151 | 8-119-377 | C | T | 1 | 230265 | 230253 | 230277 | P151 |
| 8-119 | A152 | 8-119-309 | C | T | 1 | 230333 | 230321 | 230345 | P152 |
| 8-119 | A153 | 8-119-294 | G | T | 1 | 230348 | 230336 | 230360 | P153 |
| 8-119 | A154 | 8-119-284 | G | C | 1 | 230358 | 230346 | 230370 | P154 |
| 8-119 | A155 | 8-119-272 | A | T | 1 | 230370 | 230358 | 230382 | P155 |
| 8-119 | A156 | 8-119-262 | A | T | 1 | 230380 | 230368 | 230392 | P156 |
| 8-119 | A157 | 8-119-248 | C | T | 1 | 230394 | 230382 | 230406 | P157 |
| 8-119 | A158 | 8-119-247 | A | G | 1 | 230395 | 230383 | 230407 | P158 |
| 8-119 | A159 | 8-119-210 | A | C | 1 | 230432 | 230420 | 230444 | P159 |
| 8-119 | A160 | 8-119-204 | A | C | 1 | 230438 | 230426 | 230450 | P160 |
| 8-119 | A161 | 8-119-200 | A | G | 1 | 230442 | 230430 | 230454 | P161 |
| 8-119 | A162 | 8-119-195 | A | C | 1 | 230447 | 230435 | 230459 | P162 |
| 8-119 | A163 | 8-119-125 | C | T | 1 | 230517 | 230505 | 230529 | P163 |
| 8-119 | A164 | 8-119-120 | A | G | 1 | 230522 | 230510 | 230534 | P164 |
| 8-119 | A165 | 8-119-97 | C | T | 1 | 230545 | 230533 | 230557 | P165 |
| 8-119 | A166 | 8-119-93 | G | T | 1 | 230549 | 230537 | 230561 | P166 |
| 8-119 | A167 | 8-119-38 | A | T | 1 | 230604 | 230592 | 230616 | P167 |
| 8-138 | A168 | 8-138-234 | C | T | 1 | 230684 | 230672 | 230696 | P168 |
| 8-138 | A169 | 8-138-218 | A | G | 1 | 230700 | 230688 | 230712 | P169 |
| 8-138 | A170 | 8-138-163 | C | T | 1 | 230755 | 230743 | 230767 | P170 |
| 8-138 | A171 | 8-138-54 | insertion TA | | 1 | 230864 | 230852 | 230876 | P171 |
| 8-175 | A172 | 8-175-75 | G | T | 1 | 231070 | 231058 | 231082 | P172 |
| 8-142 | A173 | 8-142-386 | C | T | 1 | 231118 | 231106 | 231130 | P173 |
| 8-142 | A174 | 8-142-370 | C | T | 1 | 231134 | 231122 | 231146 | P174 |
| 8-142 | A175 | 8-142-211 | deletion CAAA | | 1 | 231290 | 231278 | 231302 | P175 |
| 8-142 | A176 | 8-142-132 | A | G | 1 | 231372 | 231360 | 231384 | P176 |
| 8-145 | A177 | 8-145-339 | C | T | 1 | 231669 | 231657 | 231681 | P177 |
| 99-15870 | A178 | 99-15870-400 | A | G | 1 | 231677 | 231665 | 231689 | P178 |
| 8-145 | A179 | 8-145-231 | A | T | 1 | 231777 | 231765 | 231789 | P179 |
| 8-145 | A180 | 8-145-197 | C | T | 1 | 231811 | 231799 | 231823 | P180 |
| 8-145 | A181 | 8-145-154 | C | T | 1 | 231854 | 231842 | 231866 | P181 |
| 8-145 | A182 | 8-145-138 | A | C | 1 | 231870 | 231858 | 231882 | P182 |
| 8-145 | A183 | 8-145-78 | G | C | 1 | 231930 | 231918 | 231942 | P183 |
| 8-171 | A184 | 8-171-247 | C | T | 1 | 232320 | 232308 | 232332 | P184 |
| 8-170 | A185 | 8-170-373 | C | T | 1 | 232477 | 232465 | 232489 | P185 |
| 8-169 | A186 | 8-169-266 | A | G | 1 | 232898 | 232886 | 232910 | P186 |
| 8-169 | A187 | 8-169-166 | G | T | 1 | 232998 | 232986 | 233010 | P187 |
| 8-168 | A188 | 8-168-380 | A | G | 1 | 233100 | 233088 | 233112 | P188 |
| 8-235 | A189 | 8-235-349 | C | T | 1 | 233453 | 233441 | 233465 | P189 |
| 8-235 | A190 | 8-235-182 | G | T | 1 | 233620 | 233608 | 233632 | P190 |
| 8-137 | A191 | 8-137-340 | G | C | 1 | 234120 | 234108 | 234132 | P191 |
| 8-137 | A192 | 8-137-182 | C | T | 1 | 234277 | 234265 | 234289 | P192 |
| 8-137 | A193 | 8-137-152 | A | C | 1 | 234307 | 234295 | 234319 | P193 |
| 8-165 | A194 | 8-165-185 | G | C | 1 | 234751 | 234739 | 234763 | P194 |
| 99-16087 | A195 | 99-16087-219 | G | C | 1 | 235315 | 235303 | 235327 | P195 |
| 8-157 | A196 | 8-157-177 | A | C | 1 | 238223 | 238211 | 238235 | P196 |
| 8-155 | A197 | 8-155-258 | C | T | 1 | 238789 | 238777 | 238801 | P197 |
| 99-16038 | A198 | 99-16038-118 | C | T | 1 | 239763 | 239751 | 239775 | P198 |
| 8-136 | A199 | 8-136-166 | A | G | 1 | 239864 | 239852 | 239876 | P199 |
| 8-136 | A200 | 8-136-145 | A | G | 1 | 239885 | 239873 | 239897 | P200 |

TABLE 6b-continued

| | | | Biallelic Markers | | | | | | |
|---|---|---|---|---|---|---|---|---|---|
| 8-136 | A201 | 8-136-80 | C | T | 1 | 239950 | 239938 | 239962 | P201 |
| 8-153 | A202 | 8-153-32 | A | G | 1 | 240044 | 240032 | 240056 | P202 |
| 8-135 | A203 | 8-135-212 | A | G | 1 | 240497 | 240485 | 240509 | P203 |
| 8-135 | A204 | 8-135-166 | G | T | 1 | 240543 | 240531 | 240555 | P204 |
| 8-135 | A205 | 8-135-112 | A | G | 1 | 240597 | 240585 | 240609 | P205 |
| 99-16050 | A206 | 99-16050-235 | G | C | 1 | 240772 | 240760 | 240784 | P206 |
| 8-144 | A207 | 8-144-378 | C | T | 1 | 240858 | 240846 | 240870 | P207 |
| 8-144 | A208 | 8-144-234 | C | T | 1 | 241002 | 240990 | 241014 | P208 |
| 8-144 | A209 | 8-144-196 | A | T | 1 | 241040 | 241028 | 241052 | P209 |
| 8-144 | A210 | 8-144-127 | deletion TGGATAC | | 1 | 241002 | 240090 | 241014 | P210 |
| 8-141 | A211 | 8-141-304 | C | T | 1 | 241217 | 241205 | 241229 | P211 |
| 8-141 | A212 | 8-141-260 | C | T | 1 | 241261 | 241249 | 241273 | P212 |
| 8-141 | A213 | 8-141-161 | G | T | 1 | 241360 | 241348 | 241372 | P213 |
| 8-140 | A214 | 8-140-286 | A | G | 1 | 241507 | 241495 | 241519 | P214 |
| 8-140 | A215 | 8-140-173 | A | C | 1 | 241620 | 241608 | 241632 | P215 |
| 8-140 | A216 | 8-140-108 | G | C | 1 | 241685 | 241673 | 241697 | P216 |
| 8-140 | A217 | 8-140-41 | A | G | 1 | 241752 | 241740 | 241764 | P217 |
| 99-15880 | A218 | 99-15880-162 | A | G | 1 | 241861 | 241849 | 241873 | P218 |
| 8-240 | A219 | 8-240-187 | G | T | 1 | 242402 | 242390 | 242414 | P219 |
| 8-225 | A220 | 8-225-281 | A | T | 1 | 244313 | 244301 | 244325 | P220 |
| 99-25940 | A221 | 99-25940-186 | A | G | 1 | 247860 | 247848 | 247872 | P221 |
| 99-25940 | A222 | 99-25940-182 | C | T | 1 | 247864 | 247852 | 247876 | P222 |
| 99-16032 | A223 | 99-16032-292 | G | T | 1 | 248315 | 248303 | 248327 | P223 |
| 99-16055 | A224 | 99-16055-216 | A | G | 1 | 253619 | 253607 | 253631 | P224 |
| 99-16105 | A225 | 99-16105-152 | A | G | 1 | 255848 | 255836 | 255860 | P225 |
| 99-16101 | A226 | 99-16101-436 | C | T | 1 | 258573 | 258561 | 258585 | P226 |
| 99-16033 | A227 | 99-16033-244 | A | G | 1 | 260099 | 260087 | 260111 | P227 |
| 99-15875 | A228 | 99-15875-165 | C | T | 1 | 279789 | 279777 | 279801 | P228 |
| 99-13521 | A229 | 99-13521-31 | A | G | 1 | 288007 | 287995 | 288019 | P229 |
| 8-112 | A230 | 8-112-241 | C | T | 1 | 292680 | 292668 | 292692 | P230 |
| 8-112 | A231 | 8-112-155 | A | C | 1 | 292766 | 292754 | 292778 | P231 |
| 8-112 | A232 | 8-112-45 | A | T | 1 | 292876 | 292864 | 292888 | P232 |
| 8-111 | A233 | 8-111-301 | deletion AGAT | | 1 | 295491 | 295479 | 295503 | P233 |
| 8-110 | A234 | 8-110-404 | G | C | 1 | 295716 | 295704 | 295728 | P234 |
| 8-110 | A235 | 8-110-89 | A | G | 1 | 296031 | 296019 | 296043 | P235 |
| 8-134 | A236 | 8-134-94 | C | T | 1 | 296068 | 296056 | 296080 | P236 |
| 99-7462 | A237 | 99-7462-508 | C | T | 1 | 298969 | 298957 | 298981 | P237 |
| 99-16052 | A238 | 99-16052-214 | A | G | 1 | 300365 | 300353 | 300377 | P238 |
| 99-16047 | A239 | 99-16047-115 | A | G | 1 | 312030 | 312018 | 312042 | P239 |
| 99-25993 | A240 | 99-25993-280 | G | C | 1 | 315928 | 315916 | 315940 | P240 |
| 99-25993 | A241 | 99-25993-367 | A | G | 1 | 316014 | 316002 | 316026 | P241 |
| 99-25101 | A242 | 99-25101-151 | A | G | 1 | 317245 | 317233 | 317257 | P242 |

| Amplicon | BM | Marker Name | Polymorphism all1 | all2 | SEQ ID No. | BM position | Position of probes in SEQ ID No. | | Probes |
|---|---|---|---|---|---|---|---|---|---|
| 8-94 | A243 | 8-94-252 | A | G | 162 | 1501 | 1489 | 1513 | P243 |
| 8-95 | A244 | 8-95-43 | T | C | 161 | 1501 | 1489 | 1513 | P244 |
| 8-97 | A245 | 8-97-98 | G | A | 160 | 1501 | 1489 | 1513 | P245 |
| 8-98 | A246 | 8-98-68 | T | C | 159 | 1501 | 1489 | 1513 | P246 |
| 99-14021 | A247 | 99-14021-108 | A | G | 151 | 1501 | 1489 | 1513 | P247 |
| 99-14364 | A248 | 99-14364-415 | G | A | 152 | 1501 | 1489 | 1513 | P248 |
| 99-15056 | A249 | 99-15056-99 | G | A | 115 | 1501 | 1489 | 1513 | P249 |
| 99-15063 | A250 | 99-15063-155 | A | C | 116 | 1501 | 1489 | 1513 | P250 |
| 99-15065 | A251 | 99-15065-85 | C | G | 117 | 1501 | 1489 | 1513 | P251 |
| 99-15229 | A252 | 99-15229-412 | T | C | 157 | 1501 | 1489 | 1513 | P252 |
| 99-15231 | A253 | 99-15231-219 | T | G | 163 | 1501 | 1489 | 1513 | P253 |
| 99-15232 | A254 | 99-15232-291 | G | T | 155 | 1501 | 1489 | 1513 | P254 |
| 99-15239 | A255 | 99-15239-377 | G | C | 164 | 1501 | 1489 | 1513 | P255 |
| 99-15252 | A256 | 99-15252-404 | C | T | 118 | 404 | 392 | 416 | P256 |
| 99-15253 | A257 | 99-15253-382 | C | T | 119 | 1501 | 1489 | 1513 | P257 |
| 99-15256 | A258 | 99-15256-392 | C | T | 120 | 1501 | 1489 | 1513 | P258 |
| 99-15258 | A259 | 99-15258-337 | G | T | 121 | 1501 | 1489 | 1513 | P259 |
| 99-15261 | A260 | 99-15261-202 | A | G | 122 | 1501 | 1489 | 1513 | P260 |
| 99-15280 | A261 | 99-15280-432 | C | T | 123 | 1501 | 1489 | 1513 | P261 |
| 99-15355 | A262 | 99-15355-150 | C | T | 124 | 1501 | 1489 | 1513 | P262 |
| 99-15663 | A263 | 99-15663-298 | G | A | 175 | 1501 | 1489 | 1513 | P263 |
| 99-15664 | A264 | 99-15664-185 | C | A | 176 | 1501 | 1489 | 1513 | P264 |
| 99-15665 | A265 | 99-15665-398 | T | C | 174 | 1501 | 1489 | 1513 | P265 |
| 99-15668 | A266 | 99-15668-139 | C | T | 177 | 1501 | 1489 | 1513 | P266 |
| 99-15672 | A267 | 99-15672-166 | G | A | 173 | 1501 | 1489 | 1513 | P267 |
| 99-15682 | A268 | 99-15682-318 | A | T | 178 | 1501 | 1489 | 1513 | P268 |
| 99-16081 | A269 | 99-16081-217 | C | T | 113 | 330 | 318 | 342 | P269 |

TABLE 6b-continued

| Biallelic Markers | | | | | | | | | |
|---|---|---|---|---|---|---|---|---|---|
| 99-16082 | A270 | 99-16082-218 | A | G | 114 | 233 | 221 | 245 | P270 |
| 99-20933 | A271 | 99-20933-81 | T | G | 179 | 1501 | 1489 | 1513 | P271 |
| 99-20977 | A272 | 99-20977-72 | A | C | 147 | 1501 | 1489 | 1513 | P272 |
| 99-20978 | A273 | 99-20978-89 | C | G | 148 | 1501 | 1489 | 1513 | P273 |
| 99-20981 | A274 | 99-20981-300 | A | G | 149 | 1501 | 1489 | 1513 | P274 |
| 99-20983 | A275 | 99-20983-48 | T | C | 150 | 1501 | 1489 | 1513 | P275 |
| 99-22310 | A276 | 99-22310-148 | G | A | 154 | 1501 | 1489 | 1513 | P276 |
| 99-25029 | A277 | 99-25029-241 | G | A | 180 | 1501 | 1489 | 1513 | P277 |
| 99-25224 | A278 | 99-25224-189 | A | G | 125 | 1126 | 1114 | 1138 | P278 |
| 99-25869 | A279 | 99-25869-182 | A | C | 181 | 1501 | 1489 | 1513 | P279 |
| 99-25881 | A280 | 99-25881-275 | G | T | 182 | 1501 | 1489 | 1513 | P280 |
| 99-25897 | A281 | 99-25897-264 | A | T | 183 | 1501 | 1489 | 1513 | P281 |
| 99-25906 | A282 | 99-25906-131 | G | T | 184 | 1501 | 1489 | 1513 | P282 |
| 99-25917 | A283 | 99-25917-115 | G | A | 185 | 1501 | 1489 | 1513 | P283 |
| 99-25924 | A284 | 99-25924-215 | G | C | 186 | 1501 | 1489 | 1513 | P284 |
| 99-25950 | A285 | 99-25950-121 | G | C | 126 | 1501 | 1489 | 1513 | P285 |
| 99-25961 | A286 | 99-25961-376 | T | G | 127 | 1501 | 1489 | 1513 | P286 |
| 99-25965 | A287 | 99-25965-399 | T | C | 128 | 1501 | 1489 | 1513 | P287 |
| 99-25966 | A288 | 99-25966-241 | T | C | 129 | 1501 | 1489 | 1513 | P288 |
| 99-25967 | A289 | 99-25967-57 | T | C | 130 | 1501 | 1489 | 1513 | P289 |
| 99-25969 | A290 | 99-25969-200 | C | A | 131 | 1501 | 1489 | 1513 | P290 |
| 99-25972 | A291 | 99-25972-317 | G | A | 132 | 1501 | 1489 | 1513 | P291 |
| 99-25974 | A292 | 99-25974-143 | T | C | 133 | 1501 | 1489 | 1513 | P292 |
| 99-25977 | A293 | 99-25977-311 | A | G | 134 | 1501 | 1489 | 1513 | P293 |
| 99-25978 | A294 | 99-25978-166 | T | C | 135 | 1501 | 1489 | 1513 | P294 |
| 99-25979 | A295 | 99-25979-93 | A | G | 136 | 1501 | 1489 | 1513 | P295 |
| 99-25980 | A296 | 99-25980-173 | A | T | 137 | 1501 | 1489 | 1513 | P296 |
| 99-25984 | A297 | 99-25984-312 | G | A | 138 | 1501 | 1489 | 1513 | P297 |
| 99-25985 | A298 | 99-25985-194 | C | T | 139 | 1501 | 1489 | 1513 | P298 |
| 99-25989 | A299 | 99-25989-398 | T | C | 140 | 1501 | 1489 | 1513 | P299 |
| 99-26126 | A300 | 99-26126-498 | A | G | 165 | 1501 | 1489 | 1513 | P300 |
| 99-26138 | A301 | 99-26138-193 | C | T | 187 | 1501 | 1489 | 1513 | P301 |
| 99-26146 | A302 | 99-26146-264 | C | A | 188 | 1501 | 1489 | 1513 | P302 |
| 99-26147 | A303 | 99-26147-396 | G | A | 141 | 1501 | 1489 | 1513 | P303 |
| 99-26150 | A304 | 99-26150-276 | T | C | 142 | 1501 | 1489 | 1513 | P304 |
| 99-26153 | A305 | 99-26153-44 | A | C | 143 | 1501 | 1489 | 1513 | P305 |
| 99-26154 | A306 | 99-26154-107 | G | T | 144 | 1501 | 1489 | 1513 | P306 |
| 99-26156 | A307 | 99-26156-290 | A | C | 145 | 1501 | 1489 | 1513 | P307 |
| 99-26166 | A308 | 99-26166-257 | G | A | 166 | 1501 | 1489 | 1513 | P308 |
| 99-26167 | A309 | 99-26167-278 | T | C | 167 | 1501 | 1489 | 1513 | P309 |
| 99-26169 | A310 | 99-26169-211 | T | C | 168 | 1501 | 1489 | 1513 | P310 |
| 99-26171 | A311 | 99-26171-71 | A | G | 169 | 1501 | 1489 | 1513 | P311 |
| 99-26183 | A312 | 99-26183-156 | C | T | 170 | 1501 | 1489 | 1513 | P312 |
| 99-26189 | A313 | 99-26189-164 | C | A | 189 | 1501 | 1489 | 1513 | P313 |
| 99-26190 | A314 | 99-26190-20 | C | A | 190 | 1501 | 1489 | 1513 | P314 |
| 99-26191 | A315 | 99-26191-58 | G | A | 191 | 1501 | 1489 | 1513 | P315 |
| 99-26201 | A316 | 99-26201-267 | C | G | 192 | 1501 | 1489 | 1513 | P316 |
| 99-26222 | A317 | 99-26222-149 | A | G | 193 | 1501 | 1489 | 1513 | P317 |
| 99-26223 | A318 | 99-26223-225 | G | T | 194 | 1501 | 1489 | 1513 | P318 |
| 99-26225 | A319 | 99-26225-148 | G | T | 195 | 1501 | 1489 | 1513 | P319 |
| 99-26228 | A320 | 99-26228-172 | G | C | 196 | 1501 | 1489 | 1513 | P320 |
| 99-26233 | A321 | 99-26233-275 | T | C | 197 | 1501 | 1489 | 1513 | P321 |
| 99-26234 | A322 | 99-26234-336 | C | G | 198 | 1501 | 1489 | 1513 | P322 |
| 99-26238 | A323 | 99-26238-186 | T | A | 199 | 1501 | 1489 | 1513 | P323 |
| 99-5873 | A324 | 99-5873-159 | G | A | 146 | 1501 | 1489 | 1513 | P324 |
| 99-5912 | A325 | 99-5912-49 | A | G | 171 | 1501 | 1489 | 1513 | P325 |
| 99-6012 | A326 | 99-6012-220 | G | T | 158 | 1501 | 1489 | 1513 | P326 |
| 99-6080 | A327 | 99-6080-99 | G | A | 156 | 1501 | 1489 | 1513 | P327 |
| 99-7308 | A328 | 99-7308-157 | C | T | 153 | 1501 | 1489 | 1513 | P328 |
| 99-7337 | A329 | 99-7337-204 | A | C | 172 | 1501 | 1489 | 1513 | P329 |
| 99-16106 | A330 | 99-16106-48 | G | T | 200 | 79 | 67 | 91 | P330 |
| 99-25332 | A331 | 99-25332-125 | A | G | 201 | 125 | 113 | 137 | P331 |
| 99-25516 | A332 | 99-25516-307 | C | T | 202 | 306 | 294 | 318 | P332 |
| 99-26173 | A333 | 99-26173-470 | C | T | 203 | 1501 | 1489 | 1513 | P333 |
| 99-26267 | A334 | 99-26267-524 | C | T | 204 | 1501 | 1489 | 1513 | P334 |
| 99-26284 | A335 | 99-26284-394 | G | A | 205 | 1501 | 1489 | 1513 | P335 |
| 99-26559 | A336 | 99-26559-315 | A | G | 206 | 1501 | 1489 | 1513 | P336 |
| 99-26769 | A337 | 99-26769-256 | A | T | 207 | 1501 | 1489 | 1513 | P337 |
| 99-26772 | A338 | 99-26772-268 | C | T | 208 | 1501 | 1489 | 1513 | P338 |
| 99-26776 | A339 | 99-26776-209 | G | T | 209 | 1501 | 1489 | 1513 | P339 |
| 99-26779 | A340 | 99-26779-437 | G | C | 210 | 1497 | 1485 | 1509 | P340 |
| 99-26781 | A341 | 99-26781-25 | G | T | 211 | 1501 | 1489 | 1513 | P341 |
| 99-26782 | A342 | 99-26782-300 | A | G | 212 | 1501 | 1489 | 1513 | P342 |
| 99-26783 | A343 | 99-26783-81 | A | T | 213 | 1501 | 1489 | 1513 | P343 |
| 99-26787 | A344 | 99-26787-96 | A | G | 214 | 1501 | 1489 | 1513 | P344 |
| 99-26789 | A345 | 99-26789-201 | C | T | 215 | 1501 | 1489 | 1513 | P345 |
| 99-27297 | A346 | 99-27297-280 | T | C | 216 | 1501 | 1489 | 1513 | P346 |

TABLE 6b-continued

| | | Biallelic Markers | | | | | | | |
|---|---|---|---|---|---|---|---|---|---|
| 99-27306 | A347 | 99-27306-108 | C | T | 217 | 1501 | 1489 | 1513 | P347 |
| 99-27312 | A348 | 99-27312-58 | A | C | 218 | 1501 | 1489 | 1513 | P348 |
| 99-27323 | A349 | 99-27323-372 | G | C | 219 | 1501 | 1489 | 1513 | P349 |
| 99-27335 | A350 | 99-27335-191 | A | C | 220 | 1501 | 1489 | 1513 | P350 |
| 99-27345 | A351 | 99-27345-189 | C | G | 221 | 1501 | 1489 | 1513 | P351 |
| 99-27349 | A352 | 99-27349-267 | G | A | 222 | 1501 | 1489 | 1513 | P352 |
| 99-27352 | A353 | 99-27352-197 | C | G | 223 | 1501 | 1489 | 1513 | P353 |
| 99-27353 | A354 | 99-27353-105 | T | C | 224 | 1501 | 1489 | 1513 | P354 |
| 99-27360 | A355 | 99-27360-142 | G | T | 225 | 1501 | 1489 | 1513 | P355 |
| 99-27361 | A356 | 99-27361-181 | A | G | 226 | 1501 | 1489 | 1513 | P356 |
| 99-27365 | A357 | 99-27365-421 | C | T | 227 | 1501 | 1489 | 1513 | P357 |
| 99-27680 | A358 | 99-27680-484 | G | T | 228 | 484 | 472 | 496 | P358 |
| 99-27912 | A359 | 99-27912-272 | C | T | 229 | 1501 | 1489 | 1513 | P359 |
| 99-30329 | A360 | 99-30329-380 | C | T | 112 | 380 | 368 | 392 | P360 |

Certain biallelic markers of the invention are insertions or deletions, as indicated above. In particular, the deletion of the nucleotides AGAT (A223, biallelic marker 8-111-301) in Table 6b above may comprise a single deletion of the AGAT motif, or deletions of two or more AGAT motifs. This marker (A223) may thus also serve as a microsatellite marker.

BM refers to "biallelic marker". All1 and all2 refer respectively to allele 1 and allele 2 of the biallelic marker.

b) Identification of Polymorphisms by Comparison of Genomic DNA from Overlapping BACs Genomic DNA from multiple BACs derived from the same DNA donor sample and overlapping in regions of genomic DNA of SEQ ID No. 1 was sequenced. Sequencing was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were determined using gel image analysis (ABI Prism DNA Sequencing Analysis software (2.1.2 version)).

The sequence data from the overlapping regions of SEQ ID No. 1 were evaluated to detect the presence of sequence polymorphisms. The comparison of sequences identified sequence polymorphisms including single nucleotide substitutions and deletions, and multiple nucleotide deletions. The localization of these polymorphisms within SEQ ID No. 1 is shown below in Table 6c.

TABLE 6c

Polymorphisms

| Ref. No. | Polymorphism type | Allele 1 | Allele 2 | Position in SEQ ID No. 1 |
|---|---|---|---|---|
| A361 | Deletion | AAGG | | 61595 to 61598 |
| A362 | Deletion | ATTTT | | 75217 to 75221 |
| A363 | Polymorphic base | C | T | 75367 |
| A364 | Deletion | CACA | | 88634 to 88637 |
| A365 | Polymorphic base | A | G | 90113 |
| A366 | Deletion | ACAC | | 93698 to 93701 |
| A367 | Polymorphic base | C | T | 94209 |
| A368 | Deletion | AATG | | 94331 to 94334 |
| A369 | Polymorphic base | A | G | 95396 |
| A370 | Polymorphic base | C | T | 95810 |
| A371 | Polymorphic base | C | T | 96956 |
| A372 | Polymorphic base | A | G | 97156 |
| A373 | Deletion | CTTTCTTTCT | | 98749 to 98758 |
| A374 | Deletion | TA | | 104314 to 104315 |
| A375 | Polymorphic base | A | C | 104455 |
| A376 | Polymorphic base | A | G | 104699 |
| A377 | Polymorphic base | C | T | 106253 |
| A378 | Polymorphic base | A | T | 106272 |
| A379 | Polymorphic base | A | C | 106350 |
| A380 | Polymorphic base | A | G | 106384 |
| A381 | Polymorphic base | A | G | 107158 |
| A382 | Deletion | AT | | 107168 to 107169 |
| A383 | Polymorphic base | A | G | 107609 |
| A384 | Polymorphic base | A | G | 108032 |
| A385 | Deletion | ATGGAGATGGCAACACCTACATGTGACCTTTCCAGCATGGCAGTCTCAGAGTGGATATGGCAACAGCTGCACATGACCTCTCCAGCATGGCAGTCTCAGAGTGGATATGG | | 108668 to 108816 |

TABLE 6c-continued

Polymorphisms

| Ref. No. | Polymorphism type | Allele 1 | Allele 2 | Position in SEQ ID No. 1 |
|---|---|---|---|---|
| | | CAACAGCTGCA | | |
| | | CATGACCTCTC | | |
| | | CGGCATGGCAG | | |
| | | TCTCAG | | |
| A386 | Polymorphic base | G | T | 110222 |
| A387 | Polymorphic base | A | G | 111978 |
| A388 | Polymorphic base | G | T | 112468 |
| A389 | Deletion | ACTT | | 117324 to 117327 |
| A390 | Polymorphic base | C | T | 118972 |
| A391 | Deletion | TT | | 119160 to 119161 |
| A392 | Polymorphic base | C | T | 119316 |
| A393 | Polymorphic base | A | G | 119321 |
| A394 | Polymorphic base | A | G | 119526 |
| A395 | Polymorphic base | A | G | 120573 |
| A396 | Polymorphic base | A | C | 121527 |
| A397 | Polymorphic base | C | T | 126105 |
| A398 | Polymorphic base | C | G | 129789 |
| A399 | Polymorphic base | A | G | 130777 |
| A400 | Deletion | ATT | | 136942 to 136944 |
| A401 | Polymorphic base | A | T | 143839 |
| A402 | Polymorphic base | C | T | 146668 |
| A403 | Polymorphic base | C | T | 147281 |
| A404 | Polymorphic base | G | T | 147505 |
| A405 | Deletion | T | | 148183 |
| A406 | Polymorphic base | A | C | 148372 |
| A407 | Polymorphic base | A | G | 149012 |
| A408 | Polymorphic base | C | T | 149113 |
| A409 | Polymorphic base | A | G | 151637 |
| A410 | Deletion | G | | 151748 |
| A411 | Polymorphic base | A | G | 151769 |
| A412 | Polymorphic base | C | T | 151847 |
| A413 | Polymorphic base | A | C | 152691 |
| A414 | Polymorphic base | A | G | 152766 |
| A415 | Polymorphic base | C | T | 153046 |
| A416 | Polymorphic base | A | G | 153123 |
| A417 | Polymorphic base | C | T | 153925 |
| A418 | Polymorphic base | G | T | 153977 |
| A419 | Polymorphic base | C | T | 154502 |
| A420 | Polymorphic base | A | G | 154677 |
| A421 | Polymorphic base | C | T | 154879 |
| A422 | Polymorphic base | G | T | 154918 |
| A423 | Polymorphic base | C | T | 155802 |
| A424 | Polymorphic base | A | G | 156448 |
| A425 | Polymorphic base | A | C | 157238 |
| A426 | Polymorphic base | A | G | 157897 |
| A427 | Polymorphic base | A | G | 158172 |
| A428 | Polymorphic base | A | G | 158302 |
| A429 | Deletion | TT | | 158510 to 158511 |
| A430 | Polymorphic base | C | T | 158803 |
| A431 | Polymorphic base | C | T | 160172 |
| A432 | Polymorphic base | C | T | 160634 |
| A433 | Polymorphic base | C | T | 161236 |
| A434 | Polymorphic base | A | G | 162810 |
| A435 | Polymorphic base | A | G | 163007 |
| A436 | Polymorphic base | A | G | 164877 |
| A437 | Polymorphic base | C | T | 166844 |
| A438 | Deletion | TCTC | | 166911 to 166914 |
| A439 | Polymorphic base | A | G | 167754 |
| A440 | Polymorphic base | C | T | 167787 |
| A441 | Polymorphic base | G | T | 167894 |
| A442 | Polymorphic base | C | T | 168346 |
| A443 | Polymorphic base | A | G | 168414 |
| A444 | Polymorphic base | A | C | 168453 |
| A445 | Polymorphic base | A | G | 169300 |
| A446 | Polymorphic base | C | T | 169451 |
| A447 | Polymorphic base | A | G | 169627 |
| A448 | Polymorphic base | C | T | 169984 |
| A449 | Polymorphic base | C | T | 170199 |
| A450 | Polymorphic base | C | T | 170746 |
| A451 | Polymorphic base | G | T | 170858 |
| A452 | Polymorphic base | C | T | 170860 |
| A453 | Polymorphic base | C | T | 170906 |
| A454 | Polymorphic base | A | G | 171309 |
| A455 | Polymorphic base | A | G | 171413 |
| A456 | Polymorphic base | C | T | 171504 |

TABLE 6c-continued

Polymorphisms

| Ref. No. | Polymorphism type | Allele 1 | Allele 2 | Position in SEQ ID No. 1 |
|---|---|---|---|---|
| A457 | Polymorphic base | C | T | 171539 |
| A458 | Polymorphic base | C | T | 171728 |
| A459 | Polymorphic base | A | G | 171898 |
| A460 | Deletion | AA | | 172125 to 172126 |
| A461 | Polymorphic base | A | G | 172295 |
| A462 | Polymorphic base | A | G | 172298 |
| A463 | Polymorphic base | A | G | 172336 |
| A464 | Polymorphic base | A | G | 173145 |
| A465 | Polymorphic base | C | T | 173304 |
| A466 | Polymorphic base | C | T | 174227 |
| A467 | Polymorphic base | A | G | 174397 |
| A468 | Polymorphic base | C | T | 179154 |
| A469 | Polymorphic base | C | G | 180233 |
| A470 | Polymorphic base | A | G | 182552 |
| A471 | Polymorphic base | C | T | 182733 |
| A472 | Deletion | A | | 182773 |
| A473 | Polymorphic base | A | G | 185759 |
| A474 | Deletion | T | | 186307 |
| A475 | Deletion | TATC | | 186976 to 186979 |
| A476 | Polymorphic base | A | T | 188755 |
| A477 | Polymorphic base | A | C | 188991 |
| A478 | Polymorphic base | C | T | 189002 |
| A479 | Polymorphic base | A | G | 189154 |
| A480 | Polymorphic base | A | G | 189177 |
| A481 | Polymorphic base | A | G | 189604 |
| A482 | Polymorphic base | C | T | 190063 |
| A483 | Deletion | T | | 191164 |
| A484 | Deletion | A | | 193880 |
| A485 | Polymorphic base | A | G | 193897 |
| A486 | Polymorphic base | A | T | 194441 |
| A487 | Deletion | T | | 194459 |
| A488 | Polymorphic base | A | T | 195306 |
| A489 | Deletion | TATC | | 226323 to 226326 |

Example 4

Validation of the Polymorphisms Through Microsequencing

The biallelic markers identified in Example 3a were further confirmed and their respective frequencies were determined through microsequencing. Microsequencing was carried out for each individual DNA sample described in Example 1.

Amplification from genomic DNA of individuals was performed by PCR as described above for the detection of the biallelic markers with the same set of PCR primers (Table 6a).

The preferred primers used in microsequencing were about 19 nucleotides in length and hybridized just upstream of the considered polymorphic base. According to the invention, the primers used in microsequencing are detailed in Table 6d.

TABLE 6d

| Marker Name | Biallelic Marker | SEQ ID No. | Mis. 1 | Position range of microsequencing primer mis. 1 in SEQ ID No. | | Mis. 2 | Complementary position range of microsequencing primer mis. 2 in SEQ ID No. | |
|---|---|---|---|---|---|---|---|---|
| 99-27943-150 | A1 | 1 | D1 | 8297 | 8315 | E1 | 8317 | 8335 |
| 8-121-28 | A2 | 1 | D2 | 14707 | 14725 | E2 | 14727 | 14745 |
| 8-121-36 | A3 | 1 | D3 | 14715 | 14733 | E3 | 14735 | 14753 |
| 8-121-154 | A4 | 1 | D4 | 14833 | 14851 | E4 | 14853 | 14871 |
| 8-121-187 | A5 | 1 | D5 | 14866 | 14884 | E5 | 14886 | 14904 |
| 8-121-243 | A6 | 1 | D6 | 14922 | 14940 | E6 | 14942 | 14960 |
| 8-121-281 | A7 | 1 | D7 | 14960 | 14978 | E7 | 14980 | 14998 |
| 8-121-352 | A8 | 1 | D8 | 15031 | 15049 | E8 | 15051 | 15069 |
| 8-121-364 | A9 | 1 | D9 | 15043 | 15061 | E9 | 15063 | 15081 |
| 8-121-371 | A10 | 1 | D10 | 15050 | 15068 | E10 | 15070 | 15088 |
| 99-27935-193 | A11 | 1 | D11 | 21653 | 21671 | E11 | 21673 | 21691 |
| 8-122-72 | A12 | 1 | D12 | 25461 | 25479 | E12 | 25481 | 25499 |
| 8-122-100 | A13 | 1 | D13 | 25489 | 25507 | E13 | 25509 | 25527 |
| 8-122-271 | A14 | 1 | D14 | 25660 | 25678 | E14 | 25680 | 25698 |
| 8-122-272 | A15 | 1 | D15 | 25661 | 25679 | E15 | 25681 | 25699 |
| 8-122-326 | A16 | 1 | D16 | 25715 | 25733 | E16 | 25735 | 25753 |
| 8-122-360 | A17 | 1 | D17 | 25749 | 25767 | E17 | 25769 | 25787 |

TABLE 6d-continued

| | | | | | | | | |
|---|---|---|---|---|---|---|---|---|
| 8-123-55 | A18 | 1 | D18 | 29384 | 29402 | E18 | 29404 | 29422 |
| 8-123-189 | A19 | 1 | D19 | 29518 | 29536 | E19 | 29538 | 29556 |
| 8-123-197 | A20 | 1 | D20 | 29526 | 29544 | E20 | 29546 | 29564 |
| 8-123-307 | A21 | 1 | D21 | 29636 | 29654 | E21 | 29656 | 29674 |
| 8-147-270 | A22 | 1 | D22 | 29780 | 29798 | E22 | 29800 | 29818 |
| 99-34243-210 | A23 | 1 | D23 | 49456 | 49474 | E23 | 49476 | 49494 |
| 8-127-28 | A24 | 1 | D24 | 64647 | 64665 | E24 | 64667 | 64685 |
| 8-127-119 | A25 | 1 | D25 | 64738 | 64756 | E25 | 64758 | 64776 |
| 8-127-159 | A26 | 1 | D26 | 64778 | 64796 | E26 | 64798 | 64816 |
| 8-127-236 | A27 | 1 | D27 | 64855 | 64873 | E27 | 64875 | 64893 |
| 8-127-240 | A28 | 1 | D28 | 64859 | 64877 | E28 | 64879 | 64897 |
| 8-127-280 | A29 | 1 | D29 | 64899 | 64917 | E29 | 64919 | 64937 |
| 8-128-33 | A30 | 1 | D30 | 65466 | 65484 | E30 | 65486 | 65504 |
| 8-128-52 | A31 | 1 | D31 | 65485 | 65503 | E31 | 65505 | 65523 |
| 8-128-61 | A32 | 1 | D32 | 65494 | 65512 | E32 | 65514 | 65532 |
| 8-128-68 | A33 | 1 | D33 | 65501 | 65519 | E33 | 65521 | 65539 |
| 8-128-69 | A34 | 1 | D34 | 65502 | 65520 | E34 | 65522 | 65540 |
| 8-128-85 | A35 | 1 | D35 | 65518 | 65536 | E35 | 65538 | 65556 |
| 8-129-50 | A36 | 1 | D36 | 65577 | 65595 | E36 | 65597 | 65615 |
| 8-129-60 | A37 | 1 | D37 | 65587 | 65605 | E37 | 65607 | 65625 |
| 8-129-311 | A38 | 1 | D38 | 65838 | 65856 | E38 | 65858 | 65876 |
| 8-129-401 | A39 | 1 | D39 | 65928 | 65946 | E39 | 65948 | 65966 |
| 99-34240-492 | A40 | 1 | D40 | 75648 | 75666 | E40 | 75668 | 75686 |
| 99-31959-281 | A41 | 1 | D41 | 94515 | 94533 | E41 | 94535 | 94553 |
| 99-31960-363 | A42 | 1 | D42 | 95377 | 95395 | E42 | 95397 | 95415 |
| 99-31962-250 | A43 | 1 | D43 | 96937 | 96955 | E43 | 96957 | 96975 |
| 99-31962-450 | A44 | 1 | D44 | 97137 | 97155 | E44 | 97157 | 97175 |
| 99-44282-439 | A45 | 1 | D45 | 106365 | 106383 | E45 | 106385 | 106403 |
| 99-44282-54 | A46 | 1 | D46 | 106750 | 106768 | E46 | 106770 | 106788 |
| 99-24656-137 | A47 | 1 | D47 | 107139 | 107157 | E47 | 107159 | 107177 |
| 99-24656-260 | A48 | 1 | D48 | 107262 | 107280 | E48 | 107282 | 107300 |
| 99-24636-22 | A49 | 1 | D49 | 107590 | 107608 | E49 | 107610 | 107628 |
| 99-31939-75 | A50 | 1 | D50 | 108480 | 108498 | E50 | 108500 | 108518 |
| 99-31939-273 | A51 | 1 | D51 | 108778 | 108796 | E51 | 108798 | 108816 |
| 99-44281-418 | A52 | 1 | D52 | 109432 | 109450 | E52 | 109452 | 109470 |
| 99-44281-257 | A53 | 1 | D53 | 109593 | 109611 | E53 | 109613 | 109631 |
| 99-44281-77 | A54 | 1 | D54 | 109773 | 109791 | E54 | 109793 | 109811 |
| 99-31941-320 | A55 | 1 | D55 | 112449 | 112467 | E55 | 112469 | 112487 |
| 99-31942-325 | A56 | 1 | D56 | 115449 | 115467 | E56 | 115469 | 115487 |
| 99-24635-79 | A57 | 1 | D57 | 155717 | 155735 | E57 | 155737 | 155755 |
| 99-16059-313 | A58 | 1 | D58 | 158153 | 158171 | E58 | 158173 | 158191 |
| 99-24639-169 | A59 | 1 | D59 | 160615 | 160633 | E59 | 160635 | 160653 |
| 99-24639-163 | A60 | 1 | D60 | 160621 | 160639 | E60 | 160641 | 160659 |
| 99-24634-108 | A61 | 1 | D61 | 160857 | 160875 | E61 | 160877 | 160895 |
| 99-7652-162 | A62 | 1 | D62 | 168955 | 168973 | E62 | 168975 | 168993 |
| 99-7652-488 | A63 | 1 | D63 | 169281 | 169299 | E63 | 169301 | 169319 |
| 99-16100-83 | A64 | 1 | D64 | 170727 | 170745 | E64 | 170747 | 170765 |
| 99-16100-147 | A65 | 1 | D65 | 170791 | 170809 | E65 | 170811 | 170829 |
| 99-16100-195 | A66 | 1 | D66 | 170839 | 170857 | E66 | 170859 | 170877 |
| 99-16100-197 | A67 | 1 | D67 | 170841 | 170859 | E67 | 170861 | 170879 |
| 99-16100-244 | A68 | 1 | D68 | 170887 | 170905 | E68 | 170907 | 170925 |
| 99-16100-381 | A69 | 1 | D69 | 171024 | 171042 | E69 | 171044 | 171062 |
| 99-5862-167 | A70 | 1 | D70 | 173339 | 173357 | E70 | 173359 | 173377 |
| 99-16083-101 | A71 | 1 | D71 | 174208 | 174226 | E71 | 174228 | 174246 |
| 99-16044-351 | A72 | 1 | D72 | 175781 | 175799 | E72 | 175801 | 175819 |
| 99-16042-420 | A73 | 1 | D73 | 180570 | 180588 | E73 | 180590 | 180608 |
| 99-16042-31 | A74 | 1 | D74 | 180959 | 180977 | E74 | 180979 | 180997 |
| 99-5919-215 | A75 | 1 | D75 | 189938 | 189956 | E75 | 189958 | 189976 |
| 99-24658-410 | A76 | 1 | D76 | 197144 | 197162 | E76 | 197164 | 197182 |
| 99-30364-299 | A77 | 1 | D77 | 198945 | 198963 | E77 | 198965 | 198983 |
| 99-30366-112 | A78 | 1 | D78 | 200237 | 200255 | E78 | 200257 | 200275 |
| 99-16094-75 | A79 | 1 | D79 | 204569 | 204587 | E79 | 204589 | 204607 |
| 99-24644-194 | A80 | 1 | D80 | 204915 | 204933 | E80 | 204935 | 204953 |
| 99-16107-95 | A81 | 1 | D81 | 206178 | 206196 | E81 | 206198 | 206216 |
| 99-16107-161 | A82 | 1 | D82 | 206244 | 206262 | E82 | 206264 | 206282 |
| 99-16107-383 | A83 | 1 | D83 | 206466 | 206484 | E83 | 206486 | 206504 |
| 99-15873-303 | A84 | 1 | D84 | 211589 | 211607 | E84 | 211609 | 211627 |
| 8-124-106 | A85 | 1 | D85 | 214650 | 214668 | E85 | 214670 | 214688 |
| 8-124-220 | A86 | 1 | D86 | 214764 | 214782 | E86 | 214784 | 214802 |
| 8-124-294 | A87 | 1 | D87 | 214838 | 214856 | E87 | 214858 | 214876 |
| 8-124-316 | A88 | 1 | D88 | 214860 | 214878 | E88 | 214880 | 214898 |
| 8-124-383 | A89 | 1 | D89 | 214927 | 214945 | E89 | 214947 | 214965 |
| 8-125-33 | A90 | 1 | D90 | 215519 | 215537 | E90 | 215539 | 215557 |
| 8-132-312 | A91 | 1 | D91 | 215686 | 215704 | E91 | 215706 | 215724 |
| 8-132-179 | A92 | 1 | D92 | 215819 | 215837 | E92 | 215839 | 215857 |
| 8-132-164 | A93 | 1 | D93 | 215834 | 215852 | E93 | 215854 | 215872 |
| 8-132-97 | A94 | 1 | D94 | 215901 | 215919 | E94 | 215921 | 215939 |
| 99-13929-201 | A95 | 1 | D95 | 216009 | 216027 | E95 | 216029 | 216047 |
| 8-131-363 | A96 | 1 | D96 | 216519 | 216537 | E96 | 216539 | 216557 |

TABLE 6d-continued

| | | | | | | | | |
|---|---|---|---|---|---|---|---|---|
| 8-131-199 | A97 | 1 | D97 | 216683 | 216701 | E97 | 216703 | 216721 |
| 8-130-236 | A98 | 1 | D98 | 216855 | 216873 | E98 | 216875 | 216893 |
| 8-130-220 | A99 | 1 | D99 | 216871 | 216889 | E99 | 216891 | 216909 |
| 8-130-144 | A100 | 1 | D100 | 216947 | 216965 | E100 | 216967 | 216985 |
| 8-130-143 | A101 | 1 | D101 | 216948 | 216966 | E101 | 216968 | 216986 |
| 8-130-102 | A102 | 1 | D102 | 216989 | 217007 | E102 | 217009 | 217027 |
| 8-130-101 | A103 | 1 | D103 | 216990 | 217008 | E103 | 217010 | 217028 |
| 8-130-83 | A104 | 1 | D104 | 217008 | 217026 | E104 | 217028 | 217046 |
| 8-209-333 | A105 | 1 | D105 | 217188 | 217206 | E105 | 217208 | 217226 |
| 8-209-290 | A106 | 1 | D106 | 217231 | 217249 | E106 | 217251 | 217269 |
| 99-5897-143 | A107 | 1 | D107 | 219521 | 219539 | E107 | 219541 | 219559 |
| 99-24649-186 | A108 | 1 | D108 | 220817 | 220835 | E108 | 220837 | 220855 |
| 99-24649-80 | A109 | 1 | D109 | 220923 | 220941 | E109 | 220943 | 220961 |
| 8-199-84 | A110 | 1 | D110 | 221722 | 221740 | E110 | 221742 | 221760 |
| 8-198-138 | A111 | 1 | D111 | 222029 | 222047 | E111 | 222049 | 222067 |
| 8-195-348 | A112 | 1 | D112 | 222727 | 222745 | E112 | 222747 | 222765 |
| 99-13925-97 | A113 | 1 | D113 | 223576 | 223594 | E113 | 223596 | 223614 |
| 8-192-82 | A114 | 1 | D114 | 225424 | 225442 | E114 | 225444 | 225462 |
| 99-16090-225 | A115 | 1 | D115 | 226200 | 226218 | E115 | 226220 | 226238 |
| 8-189-340 | A116 | 1 | D116 | 226274 | 226292 | E116 | 226294 | 226312 |
| 8-189-146 | A117 | 1 | D117 | 226468 | 226486 | E117 | 226488 | 226506 |
| 8-188-136 | A118 | 1 | D118 | 226851 | 226869 | E118 | 226871 | 226889 |
| 8-187-352 | A119 | 1 | D119 | 226968 | 226986 | E119 | 226988 | 227006 |
| 8-185-319 | A120 | 1 | D120 | 227570 | 227588 | E120 | 227590 | 227608 |
| 8-185-296 | A121 | 1 | D121 | 227593 | 227611 | E121 | 227613 | 227631 |
| 99-16051-226 | A122 | 1 | D122 | 227987 | 228005 | E122 | 228007 | 228025 |
| 99-16051-164 | A123 | 1 | D123 | 228049 | 228067 | E123 | 228069 | 228087 |
| 8-184-119 | A124 | 1 | D124 | 228115 | 228133 | E124 | 228135 | 228153 |
| 8-184-27 | A125 | 1 | D125 | 228207 | 228225 | E125 | 228227 | 228245 |
| 8-183-401 | A126 | 1 | D126 | 228235 | 228253 | E126 | 228255 | 228273 |
| 8-181-449 | A127 | 1 | D127 | 229050 | 229068 | E127 | 229070 | 229088 |
| 8-181-350 | A128 | 1 | D128 | 229149 | 229167 | E128 | 229169 | 229187 |
| 8-181-259 | A129 | 1 | D129 | 229240 | 229258 | E129 | 229260 | 229278 |
| 8-181-230 | A130 | 1 | D130 | 229269 | 229287 | E130 | 229289 | 229307 |
| 8-181-210 | A131 | 1 | D131 | 229289 | 229307 | E131 | 229309 | 229327 |
| 8-181-165 | A132 | 1 | D132 | 229334 | 229352 | E132 | 229354 | 229372 |
| 8-181-163 | A133 | 1 | D133 | 229336 | 229354 | E133 | 229356 | 229374 |
| 8-181-83 | A134 | 1 | D134 | 229416 | 229434 | E134 | 229436 | 229454 |
| 8-180-157 | A135 | 1 | D135 | 229467 | 229485 | E135 | 229487 | 229505 |
| 8-143-332 | A136 | 1 | D136 | 229563 | 229581 | E136 | 229583 | 229601 |
| 8-143-327 | A137 | 1 | D137 | 229568 | 229586 | E137 | 229588 | 229606 |
| 8-143-311 | A138 | 1 | D138 | 229584 | 229602 | E138 | 229604 | 229622 |
| 8-143-308 | A139 | 1 | D139 | 229587 | 229605 | E139 | 229607 | 229625 |
| 8-179-268 | A140 | 1 | D140 | 229588 | 229606 | E140 | 229608 | 229626 |
| 8-143-306 | A141 | 1 | D141 | 229589 | 229607 | E141 | 229609 | 229627 |
| 8-143-245 | A142 | 1 | D142 | 229650 | 229668 | E142 | 229670 | 229688 |
| 8-143-242 | A143 | 1 | D143 | 229653 | 229671 | E143 | 229673 | 229691 |
| 8-143-239 | A144 | 1 | D144 | 229656 | 229674 | E144 | 229676 | 229694 |
| 8-143-232 | A145 | 1 | D145 | 229663 | 229681 | E145 | 229683 | 229701 |
| 8-143-152 | A146 | 1 | D146 | 229743 | 229761 | E146 | 229763 | 229781 |
| 8-178-199 | A147 | 1 | D147 | 229942 | 229960 | E147 | 229962 | 229980 |
| 8-178-123 | A148 | 1 | D148 | 230018 | 230036 | E148 | 230038 | 230056 |
| 8-119-404 | A149 | 1 | D149 | 230219 | 230237 | E149 | 230239 | 230257 |
| 8-177-281 | A150 | 1 | D150 | 230237 | 230255 | E150 | 230257 | 230275 |
| 8-119-377 | A151 | 1 | D151 | 230246 | 230264 | E151 | 230266 | 230284 |
| 8-119-309 | A152 | 1 | D152 | 230314 | 230332 | E152 | 230334 | 230352 |
| 8-119-294 | A153 | 1 | D153 | 230329 | 230347 | E153 | 230349 | 230367 |
| 8-119-284 | A154 | 1 | D154 | 230339 | 230357 | E154 | 230359 | 230377 |
| 8-119-272 | A155 | 1 | D155 | 230351 | 230369 | E155 | 230371 | 230389 |
| 8-119-262 | A156 | 1 | D156 | 230361 | 230379 | E156 | 230381 | 230399 |
| 8-119-248 | A157 | 1 | D157 | 230375 | 230393 | E157 | 230395 | 230413 |
| 8-119-247 | A158 | 1 | D158 | 230376 | 230394 | E158 | 230396 | 230414 |
| 8-119-210 | A159 | 1 | D159 | 230413 | 230431 | E159 | 230433 | 230451 |
| 8-119-204 | A160 | 1 | D160 | 230419 | 230437 | E160 | 230439 | 230457 |
| 8-119-200 | A161 | 1 | D161 | 230423 | 230441 | E161 | 230443 | 230461 |
| 8-119-195 | A162 | 1 | D162 | 230428 | 230446 | E162 | 230448 | 230466 |
| 8-119-125 | A163 | 1 | D163 | 230498 | 230516 | E163 | 230518 | 230536 |
| 8-119-120 | A164 | 1 | D164 | 230503 | 230521 | E164 | 230523 | 230541 |
| 8-119-97 | A165 | 1 | D165 | 230526 | 230544 | E165 | 230546 | 230564 |
| 8-119-93 | A166 | 1 | D166 | 230530 | 230548 | E166 | 230550 | 230568 |
| 8-119-38 | A167 | 1 | D167 | 230585 | 230603 | E167 | 230605 | 230623 |
| 8-138-234 | A168 | 1 | D168 | 230665 | 230683 | E168 | 230685 | 230703 |
| 8-138-218 | A169 | 1 | D169 | 230681 | 230699 | E169 | 230701 | 230719 |
| 8-138-163 | A170 | 1 | D170 | 230736 | 230754 | E170 | 230756 | 230774 |
| 8-138-54 | A171 | 1 | D171 | 230845 | 230863 | E171 | 230865 | 230883 |
| 8-175-75 | A172 | 1 | D172 | 231051 | 231069 | E172 | 231071 | 231089 |
| 8-142-386 | A173 | 1 | D173 | 231099 | 231117 | E173 | 231119 | 231137 |
| 8-142-370 | A174 | 1 | D174 | 231115 | 231133 | E174 | 231135 | 231153 |
| 8-142-211 | A175 | 1 | D175 | 231274 | 231292 | E175 | 231294 | 231312 |

TABLE 6d-continued

| Marker Name | Biallelic Marker | SEQ1 ID No. | Mis. 1 | Position range of microsequencing primer mis. 1 in SEQ ID No. | | Mis. 2 | Complementary position range of microsequencing primer mis. 2 in SEQ ID No. | |
|---|---|---|---|---|---|---|---|---|
| 8-142-132 | A176 | 1 | D176 | 231353 | 231371 | E176 | 231373 | 231391 |
| 8-145-339 | A177 | 1 | D177 | 231650 | 231668 | E177 | 231670 | 231688 |
| 99-15870-400 | A178 | 1 | D178 | 231658 | 231676 | E178 | 231678 | 231696 |
| 8-145-231 | A179 | 1 | D179 | 231758 | 231776 | E179 | 231778 | 231796 |
| 8-145-197 | A180 | 1 | D180 | 231792 | 231810 | E180 | 231812 | 231830 |
| 8-145-154 | A181 | 1 | D181 | 231835 | 231853 | E181 | 231855 | 231873 |
| 8-145-138 | A182 | 1 | D182 | 231851 | 231869 | E182 | 231871 | 231889 |
| 8-145-78 | A183 | 1 | D183 | 231911 | 231929 | E183 | 231931 | 231949 |
| 8-171-247 | A184 | 1 | D184 | 232301 | 232319 | E184 | 232321 | 232339 |
| 8-170-373 | A185 | 1 | D185 | 232458 | 232476 | E185 | 232478 | 232496 |
| 8-169-266 | A186 | 1 | D186 | 232879 | 232897 | E186 | 232899 | 232917 |
| 8-169-166 | A187 | 1 | D187 | 232979 | 232997 | E187 | 232999 | 233017 |
| 8-168-380 | A188 | 1 | D188 | 233081 | 233099 | E188 | 233101 | 233119 |
| 8-235-349 | A189 | 1 | D189 | 233434 | 233452 | E189 | 233454 | 233472 |
| 8-235-182 | A190 | 1 | D190 | 233601 | 233619 | E190 | 233621 | 233639 |
| 8-137-340 | A191 | 1 | D191 | 234101 | 234119 | E191 | 234121 | 234139 |
| 8-137-182 | A192 | 1 | D192 | 234258 | 234276 | E192 | 234278 | 234296 |
| 8-137-152 | A193 | 1 | D193 | 234288 | 234306 | E193 | 234308 | 234326 |
| 8-165-185 | A194 | 1 | D194 | 234732 | 234750 | E194 | 234752 | 234770 |
| 99-16087-219 | A195 | 1 | D195 | 235296 | 235314 | E195 | 235316 | 235334 |
| 8-157-177 | A196 | 1 | D196 | 238204 | 238222 | E196 | 238224 | 238242 |
| 8-155-258 | A197 | 1 | D197 | 238770 | 238788 | E197 | 238790 | 238808 |
| 99-16038-118 | A198 | 1 | D198 | 239744 | 239762 | E198 | 239764 | 239782 |
| 8-136-166 | A199 | 1 | D199 | 239845 | 239863 | E199 | 239865 | 239883 |
| 8-136-145 | A200 | 1 | D200 | 239866 | 239884 | E200 | 239886 | 239904 |
| 8-136-80 | A201 | 1 | D201 | 239931 | 239949 | E201 | 239951 | 239969 |
| 8-153-32 | A202 | 1 | D202 | 240025 | 240043 | E202 | 240045 | 240063 |
| 8-135-212 | A203 | 1 | D203 | 240478 | 240496 | E203 | 240498 | 240516 |
| 8-135-166 | A204 | 1 | D204 | 240524 | 240542 | E204 | 240544 | 240562 |
| 8-135-112 | A205 | 1 | D205 | 240578 | 240596 | E205 | 240598 | 240616 |
| 99-16050-235 | A206 | 1 | D206 | 240753 | 240771 | E206 | 240773 | 240791 |
| 8-144-378 | A207 | 1 | D207 | 240839 | 240857 | E207 | 240859 | 240877 |
| 8-144-234 | A208 | 1 | D208 | 240983 | 241001 | E208 | 241003 | 241021 |
| 8-144-196 | A209 | 1 | D209 | 241021 | 241039 | E209 | 241041 | 241059 |
| 8-144-127 | A210 | 1 | D210 | 241090 | 241108 | E210 | 241110 | 241128 |
| 8-141-304 | A211 | 1 | D211 | 241198 | 241216 | E211 | 241218 | 241236 |
| 8-141-260 | A212 | 1 | D212 | 241242 | 241260 | E212 | 241262 | 241280 |
| 8-141-161 | A213 | 1 | D213 | 241341 | 241359 | E213 | 241361 | 241379 |
| 8-140-286 | A214 | 1 | D214 | 241488 | 241506 | E214 | 241508 | 241526 |
| 8-140-173 | A215 | 1 | D215 | 241601 | 241619 | E215 | 241621 | 241639 |
| 8-140-108 | A216 | 1 | D216 | 241666 | 241684 | E216 | 241686 | 241704 |
| 8-140-41 | A217 | 1 | D217 | 241733 | 241751 | E217 | 241753 | 241771 |
| 99-15880-162 | A218 | 1 | D218 | 241842 | 241860 | E218 | 241862 | 241880 |
| 8-240-187 | A219 | 1 | D219 | 242383 | 242401 | E219 | 242403 | 242421 |
| 8-225-281 | A220 | 1 | D220 | 244294 | 244312 | E220 | 244314 | 244332 |
| 99-25940-186 | A221 | 1 | D221 | 247841 | 247859 | E221 | 247861 | 247879 |
| 99-25940-182 | A222 | 1 | D222 | 247845 | 247863 | E222 | 247865 | 247883 |
| 99-16032-292 | A223 | 1 | D223 | 248296 | 248314 | E223 | 248316 | 248334 |
| 99-16055-216 | A224 | 1 | D224 | 253600 | 253618 | E224 | 253620 | 253638 |
| 99-16105-152 | A225 | 1 | D225 | 255829 | 255847 | E225 | 255849 | 255867 |
| 99-16101-436 | A226 | 1 | D226 | 258554 | 258572 | E226 | 258574 | 258592 |
| 99-16033-244 | A227 | 1 | D227 | 260080 | 260098 | E227 | 260100 | 260118 |
| 99-15875-165 | A228 | 1 | D228 | 279770 | 279788 | E228 | 279790 | 279808 |
| 99-13521-31 | A229 | 1 | D229 | 287988 | 288006 | E229 | 288008 | 288026 |
| 8-112-241 | A230 | 1 | D230 | 292661 | 292679 | E230 | 292681 | 292699 |
| 8-112-155 | A231 | 1 | D231 | 292747 | 292765 | E231 | 292767 | 292785 |
| 8-112-45 | A232 | 1 | D232 | 292857 | 292875 | E232 | 292877 | 292895 |
| 8-111-301 | A233 | 1 | D233 | 295476 | 295494 | E233 | 295496 | 295514 |
| 8-110-404 | A234 | 1 | D234 | 295697 | 295715 | E234 | 295717 | 295735 |
| 8-110-89 | A235 | 1 | D235 | 296012 | 296030 | E235 | 296032 | 296050 |
| 8-134-94 | A236 | 1 | D236 | 296049 | 296067 | E236 | 296069 | 296087 |
| 99-7462-508 | A237 | 1 | D237 | 298950 | 298968 | E237 | 298970 | 298988 |
| 99-16052-214 | A238 | 1 | D238 | 300346 | 300364 | E238 | 300366 | 300384 |
| 99-16047-115 | A239 | 1 | D239 | 312011 | 312029 | E239 | 312031 | 312049 |
| 99-25993-280 | A240 | 1 | D240 | 315909 | 315927 | E240 | 315929 | 315947 |
| 99-25993-367 | A241 | 1 | D241 | 315995 | 316013 | E241 | 316015 | 316033 |
| 99-25101-151 | A242 | 1 | D242 | 317226 | 317244 | E242 | 317246 | 317264 |
| 8-94-252 | A243 | 162 | D243 | 1482 | 1500* | E243 | 1502 | 1521 |
| 8-95-43 | A244 | 161 | D244 | 1481 | 1500 | E244 | 1502 | 1520* |
| 8-97-98 | A245 | 160 | D245 | 1482 | 1500* | E245 | 1502 | 1521 |
| 8-98-68 | A246 | 159 | D246 | 1481 | 1500 | E246 | 1502 | 1520* |
| 99-14021-108 | A247 | 151 | D247 | 1482 | 1500* | E247 | 1502 | 1521 |

TABLE 6d-continued

| | | | | | | | | |
|---|---|---|---|---|---|---|---|---|
| 99-14364-415 | A248 | 152 | D248 | 1482 | 1500* | E248 | 1502 | 1521 |
| 99-15056-99 | A249 | 115 | D249 | 1482 | 1500* | E249 | 1502 | 1521 |
| 99-15063-155 | A250 | 116 | D250 | 1482 | 1500* | E250 | 1502 | 1521 |
| 99-15065-85 | A251 | 117 | D251 | 1481 | 1500 | E251 | 1502 | 1520* |
| 99-15229-412 | A252 | 157 | D252 | 1481 | 1500 | E252 | 1502 | 1520* |
| 99-15231-219 | A253 | 163 | D253 | 1481 | 1500 | E253 | 1502 | 1520* |
| 99-15232-291 | A254 | 155 | D254 | 1481 | 1500 | E254 | 1502 | 1520* |
| 99-15239-377 | A255 | 164 | D255 | 1482 | 1500* | E255 | 1502 | 1521 |
| 99-15252-404 | A256 | 118 | D256 | 384 | 403 | E256 | 405 | 423* |
| 99-15253-382 | A257 | 119 | D257 | 1481 | 1500 | E257 | 1502 | 1520* |
| 99-15256-392 | A258 | 120 | D258 | 1481 | 1500 | E258 | 1502 | 1520* |
| 99-15258-337 | A259 | 121 | D259 | 1481 | 1500 | E259 | 1502 | 1520* |
| 99-15261-202 | A260 | 122 | D260 | 1482 | 1500* | E260 | 1502 | 1521 |
| 99-15280-432 | A261 | 123 | D261 | 1481 | 1500 | E261 | 1502 | 1520* |
| 99-15355-150 | A262 | 124 | D262 | 1482 | 1500* | E262 | 1502 | 1521 |
| 99-15663-298 | A263 | 175 | D263 | 1482 | 1500* | E263 | 1502 | 1521 |
| 99-15664-185 | A264 | 176 | D264 | 1482 | 1500* | E264 | 1502 | 1521 |
| 99-15665-398 | A265 | 174 | D265 | 1481 | 1500 | E265 | 1502 | 1520* |
| 99-15668-139 | A266 | 177 | D266 | 1482 | 1500* | E266 | 1502 | 1521 |
| 99-15672-166 | A267 | 173 | D267 | 1482 | 1500* | E267 | 1502 | 1521 |
| 99-15682-318 | A268 | 178 | D268 | 1482 | 1500* | E268 | 1502 | 1521 |
| 99-16081-217 | A269 | 113 | D269 | 310 | 329 | E269 | 331 | 349* |
| 99-16082-218 | A270 | 114 | D270 | 214 | 232* | E270 | 234 | 253 |
| 99-20933-81 | A271 | 179 | D271 | 1481 | 1500 | E271 | 1502 | 1520* |
| 99-20977-72 | A272 | 147 | D272 | 1482 | 1500* | E272 | 1502 | 1521 |
| 99-20978-89 | A273 | 148 | D273 | 1481 | 1500 | E273 | 1502 | 1520* |
| 99-20981-300 | A274 | 149 | D274 | 1481 | 1500 | E274 | 1502 | 1520* |
| 99-20983-48 | A275 | 150 | D275 | 1482 | 1500* | E275 | 1502 | 1521 |
| 99-22310-148 | A276 | 154 | D276 | 1481 | 1500 | E276 | 1502 | 1520* |
| 99-25029-241 | A277 | 180 | D277 | 1482 | 1500* | E277 | 1502 | 1521 |
| 99-25224-189 | A278 | 125 | D278 | 1107 | 1125* | E278 | 1127 | 1146 |
| 99-25869-182 | A279 | 181 | D279 | 1482 | 1500* | E279 | 1502 | 1521 |
| 99-25881-275 | A280 | 182 | D280 | 1481 | 1500 | E280 | 1502 | 1520* |
| 99-25897-264 | A281 | 183 | D281 | 1482 | 1500* | E281 | 1502 | 1521 |
| 99-25906-131 | A282 | 184 | D282 | 1481 | 1500 | E282 | 1502 | 1520* |
| 99-25917-115 | A283 | 185 | D283 | 1481 | 1500 | E283 | 1502 | 1520* |
| 99-25924-215 | A284 | 186 | D284 | 1482 | 1500* | E284 | 1502 | 1521 |
| 99-25950-121 | A285 | 126 | D285 | 1482 | 1500* | E285 | 1502 | 1521 |
| 99-25961-376 | A286 | 127 | D286 | 1481 | 1500 | E286 | 1502 | 1520* |
| 99-25965-399 | A287 | 128 | D287 | 1481 | 1500 | E287 | 1502 | 1520* |
| 99-25966-241 | A288 | 129 | D288 | 1481 | 1500 | E288 | 1502 | 1520* |
| 99-25967-57 | A289 | 130 | D289 | 1481 | 1500 | E289 | 1502 | 1520* |
| 99-25969-200 | A290 | 131 | D290 | 1482 | 1500* | E290 | 1502 | 1521 |
| 99-25972-317 | A291 | 132 | D291 | 1482 | 1500* | E291 | 1502 | 1521 |
| 99-25974-143 | A292 | 133 | D292 | 1481 | 1500 | E292 | 1502 | 1520* |
| 99-25977-311 | A293 | 134 | D293 | 1482 | 1500* | E293 | 1502 | 1521 |
| 99-25978-166 | A294 | 135 | D294 | 1481 | 1500 | E294 | 1502 | 1520* |
| 99-25979-93 | A295 | 136 | D295 | 1482 | 1500* | E295 | 1502 | 1521 |
| 99-25980-173 | A296 | 137 | D296 | 1482 | 1500* | E296 | 1502 | 1521 |
| 99-25984-312 | A297 | 138 | D297 | 1482 | 1500* | E297 | 1502 | 1521 |
| 99-25985-194 | A298 | 139 | D298 | 1481 | 1500 | E298 | 1502 | 1520* |
| 99-25989-398 | A299 | 140 | D299 | 1481 | 1500 | E299 | 1502 | 1520* |
| 99-26126-498 | A300 | 165 | D300 | 1482 | 1500* | E300 | 1502 | 1521 |
| 99-26138-193 | A301 | 187 | D301 | 1481 | 1500 | E301 | 1502 | 1520* |
| 99-26146-264 | A302 | 188 | D302 | 1482 | 1500* | E302 | 1502 | 1521 |
| 99-26147-396 | A303 | 141 | D303 | 1482 | 1500* | E303 | 1502 | 1521 |
| 99-26150-276 | A304 | 142 | D304 | 1481 | 1500 | E304 | 1502 | 1520* |
| 99-26153-44 | A305 | 143 | D305 | 1482 | 1500* | E305 | 1502 | 1521 |
| 99-26154-107 | A306 | 144 | D306 | 1481 | 1500 | E306 | 1502 | 1520* |
| 99-26156-290 | A307 | 145 | D307 | 1482 | 1500* | E307 | 1502 | 1521 |
| 99-26166-257 | A308 | 166 | D308 | 1481 | 1500 | E308 | 1502 | 1520* |
| 99-26167-278 | A309 | 167 | D309 | 1482 | 1500* | E309 | 1502 | 1521 |
| 99-26169-211 | A310 | 168 | D310 | 1482 | 1500* | E310 | 1502 | 1521 |
| 99-26171-71 | A311 | 169 | D311 | 1481 | 1500 | E311 | 1502 | 1520* |
| 99-26183-156 | A312 | 170 | D312 | 1482 | 1500* | E312 | 1502 | 1521 |
| 99-26189-164 | A313 | 189 | D313 | 1482 | 1500* | E313 | 1502 | 1521 |
| 99-26190-20 | A314 | 190 | D314 | 1482 | 1500* | E314 | 1502 | 1521 |
| 99-26191-58 | A315 | 191 | D315 | 1481 | 1500 | E315 | 1502 | 1520* |
| 99-26201-267 | A316 | 192 | D316 | 1481 | 1500 | E316 | 1502 | 1520* |
| 99-26222-149 | A317 | 193 | D317 | 1481 | 1500 | E317 | 1502 | 1520* |
| 99-26223-225 | A318 | 194 | D318 | 1481 | 1500 | E318 | 1502 | 1520* |
| 99-26225-148 | A319 | 195 | D319 | 1481 | 1500 | E319 | 1502 | 1520* |
| 99-26228-172 | A320 | 196 | D320 | 1482 | 1500* | E320 | 1502 | 1521 |
| 99-26233-275 | A321 | 197 | D321 | 1482 | 1500* | E321 | 1502 | 1521 |
| 99-26234-336 | A322 | 198 | D322 | 1481 | 1500 | E322 | 1502 | 1520* |
| 99-26238-186 | A323 | 199 | D323 | 1481 | 1500 | E323 | 1502 | 1520* |
| 99-5873-159 | A324 | 146 | D324 | 1481 | 1500 | E324 | 1502 | 1520* |
| 99-5912-49 | A325 | 171 | D325 | 1481 | 1500 | E325 | 1502 | 1520* |
| 99-6012-220 | A326 | 158 | D326 | 1481 | 1500 | E326 | 1502 | 1520* |

TABLE 6d-continued

| | | | | | | | | |
|---|---|---|---|---|---|---|---|---|
| 99-6080-99 | A327 | 156 | D327 | 1481 | 1500 | E327 | 1502 | 1520* |
| 99-7308-157 | A328 | 153 | D328 | 1482 | 1500* | E328 | 1502 | 1521 |
| 99-7337-204 | A329 | 172 | D329 | 1482 | 1500* | E329 | 1502 | 1521 |
| 99-16106-48 | A330 | 200 | D330 | 59 | 78 | E330 | 80 | 99 |
| 99-25332-125 | A331 | 201 | D331 | 105 | 124 | E331 | 126 | 145 |
| 99-25516-307 | A332 | 202 | D332 | 286 | 305 | E332 | 307 | 326 |
| 99-26173-470 | A333 | 203 | D333 | 1481 | 1500 | E333 | 1502 | 1521 |
| 99-26267-524 | A334 | 204 | D334 | 1481 | 1500 | E334 | 1502 | 1521 |
| 99-26284-394 | A335 | 205 | D335 | 1481 | 1500 | E335 | 1502 | 1521 |
| 99-26559-315 | A336 | 206 | D336 | 1481 | 1500 | E336 | 1502 | 1521 |
| 99-26769-256 | A337 | 207 | D337 | 1481 | 1500 | E337 | 1502 | 1521 |
| 99-26772-268 | A338 | 208 | D338 | 1481 | 1500 | E338 | 1502 | 1520* |
| 99-26776-209 | A339 | 209 | D339 | 1481 | 1500 | E339 | 1502 | 1521 |
| 99-26779-437 | A340 | 210 | D340 | 1477 | 1496 | E340 | 1498 | 1517 |
| 99-26781-25 | A341 | 211 | D341 | 1482 | 1500* | E341 | 1502 | 1521 |
| 99-26782-300 | A342 | 212 | D342 | 1482 | 1500* | E342 | 1502 | 1521 |
| 99-26783-81 | A343 | 213 | D343 | 1481 | 1500 | E343 | 1502 | 1521 |
| 99-26787-96 | A344 | 214 | D344 | 1482 | 1500* | E344 | 1502 | 1521 |
| 99-26789-201 | A345 | 215 | D345 | 1482 | 1500* | E345 | 1502 | 1521 |
| 99-27297-280 | A346 | 216 | D346 | 1481 | 1500 | E346 | 1502 | 1521 |
| 99-27306-108 | A347 | 217 | D347 | 1481 | 1500 | E347 | 1502 | 1521 |
| 99-27312-58 | A348 | 218 | D348 | 1481 | 1500 | E348 | 1502 | 1521 |
| 99-27323-372 | A349 | 219 | D349 | 1481 | 1500 | E349 | 1502 | 1521 |
| 99-27335-191 | A350 | 220 | D350 | 1481 | 1500 | E350 | 1502 | 1521 |
| 99-27345-189 | A351 | 221 | D351 | 1481 | 1500 | E351 | 1502 | 1521 |
| 99-27349-267 | A352 | 222 | D352 | 1482 | 1500* | E352 | 1502 | 1521 |
| 99-27352-197 | A353 | 223 | D353 | 1481 | 1500 | E353 | 1502 | 1520* |
| 99-27353-105 | A354 | 224 | D354 | 1482 | 1500* | E354 | 1502 | 1521 |
| 99-27360-142 | A355 | 225 | D355 | 1482 | 1500* | E355 | 1502 | 1521 |
| 99-27361-181 | A356 | 226 | D356 | 1482 | 1500* | E356 | 1502 | 1521 |
| 99-27365-421 | A357 | 227 | D357 | 1482 | 1500* | E357 | 1502 | 1521 |
| 99-27680-484 | A358 | 228 | D358 | 464 | 483 | E358 | 485 | 504 |
| 99-27912-272 | A359 | 229 | D359 | 1481 | 1500 | E359 | 1502 | 1521 |
| 99-30329-380 | A360 | 112 | D360 | 361 | 379 | E360 | 381 | 399 |

Mis 1 and Mis 2 respectively refer to microsequencing primers which hybridized with the coding strand or with the non-coding strand of the nuceotide sequences of the invention.

The microsequencing reaction was performed as follows:

After purification of the amplification products, the microsequencing reaction mixture was prepared by adding, in a 20 μl final volume: 10 pmol microsequencing oligonucleotide, 1 U Thermosequenase (Amersham E79000G), 1.25 μl Thermosequenase buffer (260 mM Tris HCl pH 9.5, 65 mM $MgCl_2$), and the two appropriate fluorescent ddNTPs (Perkin Elmer, Dye Terminator Set 401095) complementary to the nucleotides at the polymorphic site of each biallelic marker tested, following the manufacturer's recommendations. After 4 minutes at 94° C., 20 PCR cycles of 15 sec at 55° C., 5 sec at 72° C., and 10 sec at 94° C. were carried out in a Tetrad PTC-225 thermocycler (MJ Research). The unincorporated dye terminators were then removed by ethanol precipitation. Samples were finally resuspended in formamide-EDTA loading buffer and heated for 2 min at 95° C. before being loaded on a polyacrylamide sequencing gel. The data were collected by an ABI PRISM 377 DNA sequencer and processed using the GENESCAN software (Perkin Elmer).

Following gel analysis, data were automatically processed with software that allows the determination of the alleles of biallelic markers present in each amplified fragment.

The software evaluates such factors as whether the intensities of the signals resulting from the above microsequencing procedures are weak, normal, or saturated, or whether the signals are ambiguous. In addition, the software identifies significant peaks (according to shape and height criteria). Among the significant peaks, peaks corresponding to the targeted site are identified based on their position.

When two significant peaks are detected for the same position, each sample is categorized classification as homozygous or heterozygous type based on the height ratio.

Example 5a

Association Study Between Schizophrenia and the Biallelic Markers of the Invention Collection of DNA Samples from Affected and Non-affected Individuals A) Affected Population All the samples were collected from a large epidemiological study of schizophrenia undertaken in hospital centers of Quebec from October 1995 to April 1997. The population was composed of French Caucasian individuals. The study design consisted in the ascertainment of cases and two of their first degree relatives (parents or siblings).

As a whole, 956 schizophrenic cases were ascertained according to the following inclusion criteria:

the diagnosis had been done by a psychiatrist;

the diagnosis had been done at least 3 years before recruitment time, in order to exclude individuals suffering from transient manic-depressive psychosis or depressive disorders;

the patient ancestors had been living in Quebec for at least 6 generations;

it was possible to get a blood sample from 2 close relatives.

Among the 956 schizophrenic ascertained cases, 834 individuals were included in the study for the following reasons:

for the included individual cases, the diagnosis of schizophrenia was established according to the DSM-IV (Diagnostic and Statistical Manual, Fourth edition, Revised 1994, American Psychiatric Press);

samples from individuals suffering from schizoaffective disorder were discarded;

individuals suffering from catatonic schizophrenia were also excluded from the population of schizophrenic cases;

were also excluded the individuals having a first degree relative or 2 or more second degree relatives suffering from depression or mood disorder;

individuals having had severe head trauma, severe obstretical complications, encephalitis, or meningitis before onset of symptoms were also excluded;

has also been excluded from the population of schizophrenic cases a patient suffering from epilepsy and treated with anticonvulsants.

The age at onset was not added as an inclusion criteria.

B) Unaffected Population

Control cases were respectively ascertained based on the following cumulative criteria:

the individual must not be affected by schizophrenia or any other psychiatric disorder;

the individual must be 35 years old or older;

the individual must belong to the French-Canadian population;

the individual must have one or two first degree relative available for blood sampling.

Controls were matched with the sex of cases when possible.

C) Cases and Control Populations Selected for the Association Study

The unaffected population retained for the study was composed of 241 individuals. The initial sample of the clinical study was composed of 215 cases and 214 controls. The controls were composed of 116 males and 98 females while the cases were composed of 154 males and 64 females. For each control, two first degree relatives (father, mother, sisters and brothers) were available. In order to match the sex of cases and controls, the parents of female controls were substituted for the female controls where possible and where the parents were known to be unaffected by schizophrenia or other psychosis. The parents of 27 female controls were thus substituted for the respective females, resulting in a total control sample size of 241 individuals. The composition of the control sample is detailed below in Table 7.

TABLE 7

Description of control samples

| Probands | 187 |
|---|---|
| Male | 116 |
| Female | 71 |
| Parents of probands | 54 |
| Fathers | 27 |
| Mothers | 27 |
| Total | 241 |

The association data that are presented below were obtained on a population size detailed in Table 8 below, wherein the individuals have been randomly selected from the populations detailed above.

TABLE 8

| Cases and Control Populations | sample type | |
|---|---|---|
| | Cases sample size | Controls sample size |
| Selected for the Association Study | 215 | 241 |
| Gender | | |
| Male | 151 | 143 |
| Female | 64 | 98 |
| Familial history of psychosis (FH)* | | |
| positive (FH+) | 82 | 0 |
| none (FH−) | 133 | 241 |

*close relatives (first or second degree)

Both case and control populations form two groups, each group consisting of unrelated individuals that do not share a known common ancestor. Additionally, the individuals of the control population were selected among those having no family history of schizophrenia or schizophrenic disorder.

Genotyping of Affected and Control Individuals

A) Results from the Genotyping

The general strategy to perform the association studies was to individually scan the DNA samples from all individuals in each of the populations described above in order to establish the allele frequencies of biallelic markers, and among them the biallelic markers of the invention, in the diploid genome of the tested individuals belonging to each of these populations.

Allelic frequencies of every biallelic marker in each population (cases and controls) were determined by performing microsequencing reactions on amplified fragments obtained by genomic PCR performed on the DNA samples from each individual. Genomic PCR and microsequencing were performed as detailed above in Examples 1 to 3 using the described PCR and microsequencing primers.

Single Biallelic Marker Frequency Analysis

For each allele of the biallelic markers included in this study, the difference between the allelic frequency in the unaffected population and in the population affected by schizophrenia was calculated and the absolute value of the difference was determined. The more the difference in allelic frequency for a particular biallelic marker or a particular set of biallelic markers, the more probable an association between the genomic region harboring this particular biallelic marker or set of biallelic markers and schizophrenia. Allelic frequencies were also useful to check that the markers used in the haplotype studies meet the Hardy-Weinberg proportions (random mating).

The allelic frequencies of biallelic markers in the chromosome 13q31-q33 region between the affected and the unaffected population, using the sample population described above, is set forth in Table 9.

TABLE 9

Allelic frequencies of markers in different sub-samples

| | | all sample | | | |
|---|---|---|---|---|---|
| | | | cases | | |
| marker | alleles | all | HF+ | HF− | controls |
| 99-20978/89 | C/G | 0.51 | 0.47 | 0.51 | 0.55 |
| 99-20983/48 | A/G | 0.30 | 0.28 | 0.33 | 0.29 |

TABLE 9-continued

Allelic frequencies of markers in different sub-samples

| marker | alleles | all sample | | | controls |
|---|---|---|---|---|---|
| | | | cases | | |
| | | all | HF+ | HF− | |
| 99-20981/300 | A/G | 0.54 | 0.51 | 0.55 | 0.56 |
| 99-20977/72 | A/C | 0.40 | 0.41 | 0.38 | 0.35 |
| 99-6080/99 | C/T | 0.58 | 0.57 | 0.57 | 0.55 |
| 99-15229/412 | A/G | 0.54 | 0.52 | 0.55 | 0.53 |
| 99-22310/148 | C/T | 0.46 | 0.48 | 0.44 | 0.47 |
| 99-15232/291 | C/T | 0.46 | 0.48 | 0.43 | 0.47 |
| 99-14021/108 | A/G | 0.46 | 0.48 | 0.44 | 0.47 |
| 8-98/68 | A/G | 0.20 | 0.18 | 0.23 | 0.19 |
| 8-97/98 | C/T | 0.78 | 0.75 | 0.81 | 0.80 |
| 99-6012/220 | C/T | 0.20 | 0.19 | 0.23 | 0.19 |
| 8-95/43 | A/G | 0.18 | 0.20 | 0.18 | 0.21 |
| 99-7308/157 | C/T | 0.39 | 0.42 | 0.36 | 0.39 |
| 99-14364/415 | C/T | 0.38 | 0.40 | 0.36 | 0.39 |
| 99-15672/166 | C/T | 0.51 | 0.47 | 0.54 | 0.54 |
| 99-15668/139 | C/T | 0.58 | 0.56 | 0.62 | 0.65 |
| 99-15665/398 | A/G | 0.72 | 0.67 | 0.72 | 0.76 |
| 99-15663/298 | C/T | 0.72 | 0.67 | 0.72 | 0.76 |
| 99-15664/185 | C/T | 0.69 | 0.62 | 0.72 | 0.72 |
| 99-15682/318 | A/T | 0.35 | 0.40 | 0.34 | 0.32 |
| 99-20933/81 | A/C | 0.43 | 0.41 | 0.42 | 0.40 |
| 99-16081/217 | C/T | 0.43 | 0.38 | 0.46 | 0.39 |
| 99-16082/218 | A/G | 0.33 | 0.31 | 0.35 | 0.32 |
| 99-5862/167 | C/T | 0.47 | 0.43 | 0.44 | 0.51 |
| 99-16100/147 | A/G | 0.48 | 0.44 | 0.45 | 0.50 |
| 99-7652/162 | A/G | 0.49 | 0.46 | 0.46 | 0.52 |
| 99-5919/215 | A/G | 0.66 | 0.71 | 0.69 | 0.60 |
| 99-5897/143 | A/C | 0.58 | 0.61 | 0.53 | 0.59 |
| 99-15870/400 | A/G | 0.32 | 0.38 | 0.27 | 0.33 |
| 99-16032/292 | A/C | 0.61 | 0.62 | 0.64 | 0.58 |
| 99-15880/162 | A/G | 0.62 | 0.63 | 0.65 | 0.58 |
| 99-16038/118 | A/G | 0.38 | 0.36 | 0.35 | 0.42 |
| 99-15875/165 | C/T | 0.58 | 0.57 | 0.57 | 0.63 |
| 99-16033/244 | C/T | 0.55 | 0.57 | 0.49 | 0.54 |
| 99-16047/115 | C/T | 0.73 | 0.75 | 0.68 | 0.73 |

In the association study described herein, several individual biallelic markers were shown to be significantly associated with schizophrenia. In particular, several of the chromosome 13q31-q33 region biallelic markers (99-16038/118 (A198), 99-15880/162 (A218), 99-5919/215 (A75), 99-15875/165 (A228), 99-16032/292 (A223)) showed significant association with schizophrenia in both familial and sporadic schizophrenia cases. The significance of the absolute value of the difference of allelic frequency of the individual biallelic markers in the affected and the unaffected population is set forth in FIG. 2, with several biallelic marker having allelic frequency differences with p-values approaching or less than 0.05, biallelic marker 99-5919/215 (A75) having a p-value of less than 0.01. FIG. 2 also shows the physical order of certain specific biallelic markers. These results show that several biallelic markers individually associated with schizophrenia are physically located in a particular region of significance, the subregion of the chromosome 13q31-q33 region referred to herein as Region D.

Haplotype Frequency Analysis

Analysis of markers Haplotype analysis for association of chromosome 13q31-q33-related biallelic markers and schizophrenia was performed by estimating the frequencies of all possible 2, 3 and 4 marker haplotypes in the affected and control populations described above. Haplotype estimations were performed by applying the Expectation-Maximization (EM) algorithm (Excoffier and Slatkin, 1995), using the EM-HAPLO program (Hawley et al., 1994) as described above. Estimated haplotype frequencies in the affected and control population were compared by means of a chi-square statistical test (one degree of freedom).

Haplotype Association Results in Schizophrenia Cases

The results of the haplotype analysis using the chromosome 13q31-q33-related biallelic markers biallelic markers is shown in FIG. 3. In particular, the figures show the most significant haplotypes using the biallelic markers: 99-16047/115 (A239), 99-16033/244 (A227), 99-16038/118 (A198), 99-15875/165 (A228), 99-16032/292 (A223), 99-5897/143 (A107), 99-15880/162 (A218), 99-16082/218 (A270), 99-5919/215 (A75), 99-7652/162 (A62), 99-16100/147 (A65), 99-5862/167 (A70).

A number of biallelic marker haplotypes were shown to be significantly associated with schizophrenia. A first preferred haplotype (HAP287 of FIG. 3) consisting of four biallelic markers (99-16038/118 (A198), 99-16082/218 (A270), (99-7652/162 (A62) and 99-16100/147 (A65)) is highly significantly associated with schizophrenia in both total cases and sporadic cases. FIG. 4 shows the characteristics of this haplotype. This haplotype presented a p-value of $3.1 \times 10^{-7}$ and an odd-ratio of 4.01 for total cases and a p-value of $3.9 \times 10^{-6}$ and an odd-ratio of 3.88 for sporadic cases. Phenotypic permutation tests confirmed the statistical significance of these results. Estimated haplotype frequencies were 13.8% in total cases, 13.5% in the sporadic cases, and 3.8% in the controls.

Several other significant haplotypes are listed in FIG. 3, including several 2-, 3- and 4-marker haplotypes. Considered to be highly significantly associated with schizophrenia are the most significant 2-marker haplotype (HAP1 consisting of biallelic markers 99-15875/165 (A228) and 99-5919/215 (A75)) and the most significant 3-marker haplotype (HAP67 consisting of biallelic markers 99-16038/118 (A198), 99-16082/218 (A270) and 99-7652/162 (A218)).

Further preferred significant haplotypes considered associated with schizophrenia are haplotypes having p-values above a desired threshold level are also; all the haplotypes listed in FIG. 3 present p-values below $1.0 \times 10^{-2}$ for 2-marker haplotypes, $1.0 \times 10^{-4}$ for 3-marker haplotypes, and $1.0 \times 10^{-5}$ for 4-marker haplotypes. All of the biallelic markers presented in FIG. 4 except for 1 (99-16047/115 (A239)) are involved in haplotypes having a p-value above these threshold levels. FIG. 3 shows several 2-marker haplotypes, HAP1 to HAP8, having p-values ranging from $1.0 \times 10^{-2}$ to $1.2 \times 10^{-3}$, several 3-marker haplotypes, HAP67 to HAP76, having p-values ranging from $1.3 \times 10^{-5}$ to $1.0 \times 10^{-4}$ and several 4-marker haplotypes, HAP287 to HAP291, having p-values ranging from $8.2 \times 10^{-7}$ to $3.1 \times 10^{-7}$. FIG. 4 shows biallelic markers involved in significant haplotypes having significance thresholds of $1.0 \times 10^{-2}$, $1.0 \times 10^{-4}$, and $1.0 \times 10^{-5}$ for 2-, 3- and 4-marker haplotypes, respectively.

Several 2-, 3- and 4-marker haplotypes, HAP 1, HAP8, HAP70, HAP71, HAP75, HAP76, HAP288, HAP290 and HAP291, often comprised the biallelic marker 99-5919/215 (A75) allele A. Furthermore, several 2-, 3- and 4-marker haplotypes, HAP7, HAP67, HAP69, HAP75, HAP287 AND HAP288, often comprised the biallelic marker 99-16038/118 (A198) allele G.

Example 5b

Association Study Between Schizophrenia and the Biallelic Markers of the Invention Collection of DNA Samples from Affected and Non-affected Individuals Biallelic markers of the invention were further analyzed in the French Canadian population described above. For this analysis, the proband case population under study consisted of 139 individuals, the control population consisted of 141 individuals, as described in Table 10 below.

TABLE 10

| Cases and Control Populations | Sample type | |
|---|---|---|
| | Cases Sample size | Controls Sample size |
| Selected for the Association Study | 139 | 141 |
| Gender | | |
| Male | 94 | 96 |
| Female | 45 | 45 |
| Familial history of psychosis (FH)* | | |
| positive (FH+) | 76 | 0 |
| none (FH−) | 63 | 141 |

*close relatives (first or second degree)

Genotyping of Affected and Control Individuals
A) Results from the Genotyping

The general strategy for performing the association studies was to individually scan the DNA samples from all individuals in each of the populations described above in order to establish the allele frequencies of biallelic markers, and among them the biallelic markers of the invention, in the diploid genome of the tested individuals belonging to each of these populations.

Allelic frequencies of every biallelic marker in each population (cases and controls) were determined by performing microsequencing reactions on amplified fragments obtained by genomic PCR performed on the DNA samples from each individual. Genomic PCR and microsequencing were performed as detailed above in Examples 1 to 3 using the described PCR and microsequencing primers.

Single Biallelic Marker Frequency Analysis

For each allele of the biallelic markers included in this study, the difference between the allelic frequency in the unaffected population and in the population affected by schizophrenia was calculated and the absolute value of the difference was determined. The allelic frequencies of between the affected and the unaffected population in the regions is set forth in Table 11, using the sample population described above and in Table 10. The more the difference in allelic frequency for a particular biallelic marker or a particular set of biallelic markers, the more probable an association between the genomic region harboring this particular biallelic marker or set of biallelic markers and schizophrenia. Allelic frequencies were also useful to check that the markers used in the haplotype studies meet the Hardy-Weinberg proportions (random mating).

TABLE 11

Allelic frequencies of markers in differents sub-samples (%)

| | | Cases | | | |
|---|---|---|---|---|---|
| Marker | polymorphism | All cases | HF+ | HF− | All controls |
| 99-20978/89 | C/G | 50.37 | 47.26 | 54.03 | 55.43 |
| 99-20983/48 | A/G | 30.37 | 28.67 | 32.5 | 26.52 |
| 99-20977/72 | A/C | 41.01 | 42.11 | 39.68 | 34.4 |
| 99-20981/300 | A/G | 52.17 | 51.33 | 53.17 | 60 |
| 99-6080/99 | C/T | 58.82 | 58 | 59.84 | 54.85 |
| 99-15229/412 | A/G | 54.92 | 52.86 | 57.26 | 51.88 |
| 99-22310/148 | C/T | 44.2 | 46.71 | 41.13 | 48.57 |
| 99-15232/291 | G/T | 43.85 | 46.43 | 40.83 | 49.28 |
| 99-14021/108 | A/G | 44.85 | 47.26 | 42.06 | 48.54 |
| 8-94/252 | A/G | 2.22 | 1.97 | 2.54 | 2.52 |
| 8-98/68 | A/G | 19.06 | 17.76 | 20.63 | 19.06 |

TABLE 11-continued

Allelic frequencies of markers in differents sub-samples (%)

| | | Cases | | | |
|---|---|---|---|---|---|
| Marker | polymorphism | All cases | HF+ | HF− | All controls |
| 8-97/98 | C/T | 76.26 | 74.34 | 78.57 | 77.3 |
| 99-6012/220 | G/T | 20 | 18.49 | 21.77 | 18.79 |
| 99-7308/157 | C/T | 40.31 | 41.89 | 38.18 | 39.36 |
| 99-14364/415 | C/T | 39.93 | 40.79 | 38.89 | 40 |
| 8-95/43 | A/G | 20.29 | 20.39 | 20.16 | 22.14 |
| 99-15672/166 | C/T | 49.28 | 47.37 | 51.59 | 56.74 |
| 99-15668/139 | C/T | 58.21 | 56.16 | 60.66 | 66.67 |
| 99-15665/398 | A/G | 70.5 | 67.76 | 73.81 | 76.79 |
| 99-15663/298 | C/T | 70.5 | 67.76 | 73.81 | 76.95 |
| 99-15664/185 | G/T | 66.54 | 62.33 | 71.43 | 72.5 |
| 99-15682/318 | A/T | 35.27 | 39.58 | 29.82 | 32.66 |
| 99-20933/81 | A/C | 43.12 | 42.76 | 43.55 | 42.45 |
| 99-26146/264 | G/T | 39.62 | 38.67 | 40.91 | 38.85 |
| 99-25922/147 | G/T | 44.19 | 39.58 | 50 | 40.94 |
| 99-16081/217 | C/T | 42.28 | 38.82 | 46.67 | 36.74 |
| 99-16082/218 | A/G | 34.73 | 31.94 | 38.14 | 33.81 |
| 99-24656/260 | A/G | 48.87 | 49.32 | 48.31 | 54.04 |
| 99-24639/163 | G/T | 38.52 | 33.33 | 45 | 40.51 |
| 99-24634/108 | A/T | 44.85 | 42.67 | 47.54 | 50 |
| 99-7652/162 | A/G | 45.29 | 44.08 | 46.77 | 50.36 |
| 99-16100/147 | A/G | 44.66 | 42.75 | 46.77 | 48.89 |
| 99-5862/167 | C/T | 43.53 | 41.45 | 46.03 | 49.29 |
| 99-5919/215 | A/G | 69.42 | 71.05 | 67.46 | 60.28 |
| 99-24658/410 | C/T | 64.13 | 69.08 | 58.06 | 61.07 |
| 99-24644/194 | A/G | 39.42 | 41.22 | 37.3 | 40.51 |
| 99-5897/143 | A/C | 57.61 | 60.67 | 53.97 | 61.07 |
| 99-24649/186 | C/T | 67.75 | 67.33 | 68.25 | 62.95 |
| 99-15870/400 | A/G | 33.46 | 36.67 | 29.51 | 30.29 |
| 99-16038/118 | A/G | 34.53 | 36.18 | 32.54 | 43.62 |
| 99-15880/162 | A/G | 65.11 | 63.16 | 67.46 | 56.43 |
| 99-25940/182 | A/G | 59.42 | 56.67 | 62.7 | 52.59 |
| 99-16032/292 | A/C | 64.03 | 61.84 | 66.67 | 55.67 |
| 99-16033/244 | C/T | 54.51 | 56.76 | 51.69 | 56.44 |
| 99-15875/165 | C/T | 56.88 | 57.89 | 55.65 | 66.3 |
| 99-16047/115 | C/T | 71.69 | 74.67 | 68.03 | 75.19 |
| 99-25993/367 | A/G | 44.53 | 40.79 | 49.18 | 40.51 |
| 99-25989/398 | A/G | 32.81 | 33.33 | 32.2 | 27.86 |
| 99-25979/93 | A/G | 68.12 | 69.08 | 66.94 | 69.32 |
| 99-25969/200 | G/T | 36.67 | 38.67 | 34.17 | 38.85 |
| 99-25966/241 | A/G | 66.3 | 67.11 | 65.32 | 63.21 |
| 99-25961/376 | A/C | 39.63 | 42.57 | 36.07 | 37.31 |
| 99-25965/399 | A/G | 50.36 | 51.97 | 48.39 | 49.64 |
| 99-25977/311 | A/G | 72.01 | 67.76 | 77.59 | 73.72 |
| 99-25950/121 | C/G | 31.75 | 36 | 26.61 | 27.54 |
| 99-25974/143 | A/G | 25.55 | 28.29 | 22.13 | 22.7 |
| 99-26150/276 | A/G | 46.54 | 51.43 | 40.83 | 47.76 |
| 99-15258/337 | G/T | 25.55 | 26.97 | 23.77 | 24.1 |
| 99-15261/202 | A/G | 63.06 | 59.46 | 67.5 | 65.15 |
| 99-15256/392 | C/T | 64.96 | 61.33 | 69.35 | 65.3 |
| 99-15056/99 | C/T | 32.72 | 36.49 | 28.23 | 31.11 |
| 99-15280/432 | C/T | 42.28 | 44 | 40.16 | 38.97 |
| 99-15355/150 | C/T | 72.3 | 70.39 | 74.6 | 68.79 |
| 99-15253/382 | C/T | 63.04 | 62.67 | 63.49 | 62.95 |
| 99-5873/159 | C/T | 78.1 | 79.05 | 76.98 | 77.34 |

Haplotype Frequency Analysis

Analysis of markers Haplotype analysis for association of chromosome 13q13-q33-related biallelic markers and schizophrenia was performed by estimating the frequencies of all possible 2, 3 and 4 marker haplotypes in the affected and control populations described above. Haplotype estimations were performed by applying the Expectation-Maximization (EM) algorithm (Excoffier and Slatkin, 1995), using the EM-HAPLO program (Hawley et al., 1994) as described above. Estimated haplotype frequencies in the affected and control population were compared by means of a chi-square statistical test (one degree of freedom).

Haplotype Association Results in Schizophrenia Cases

Figure 5:
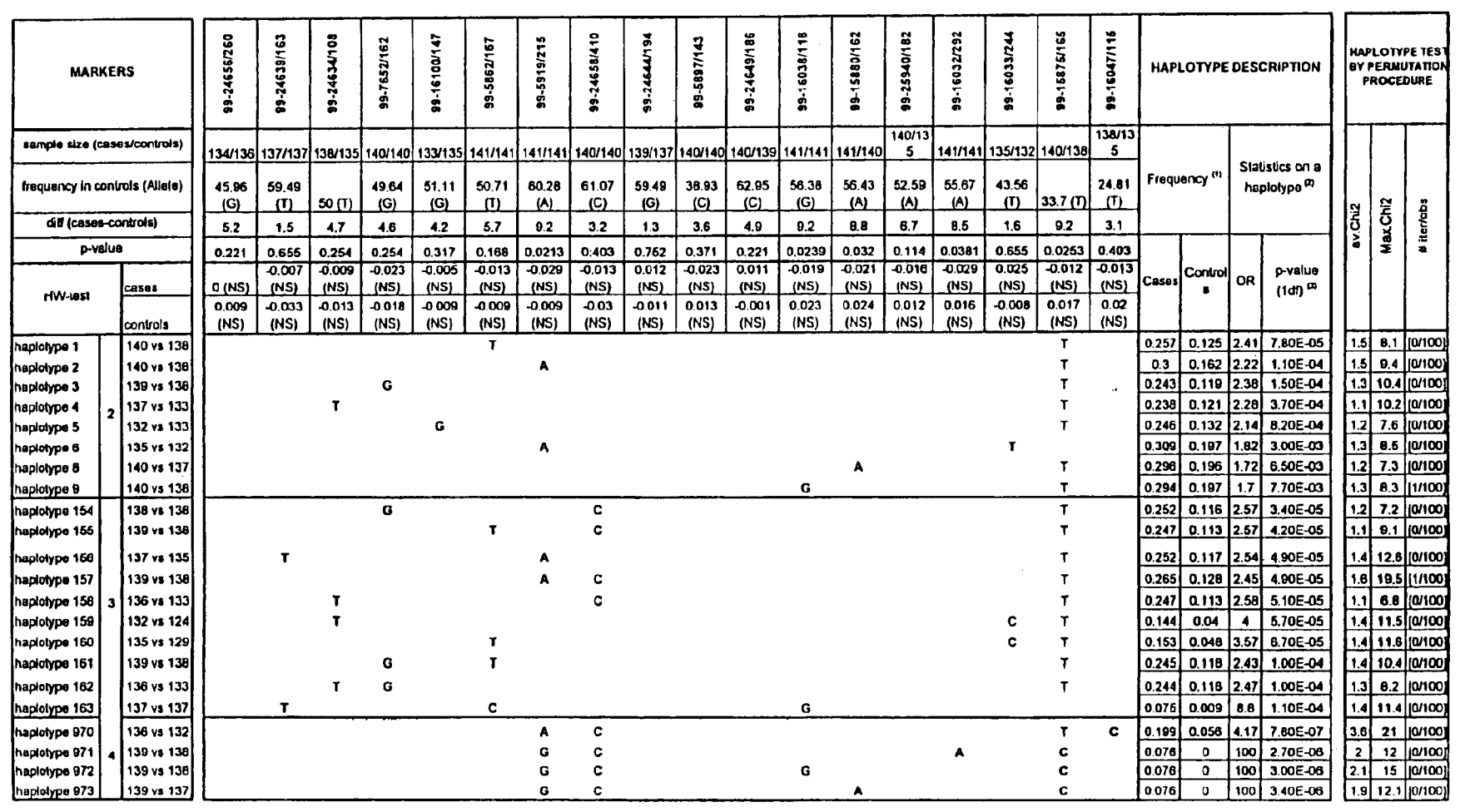
Figure 6:
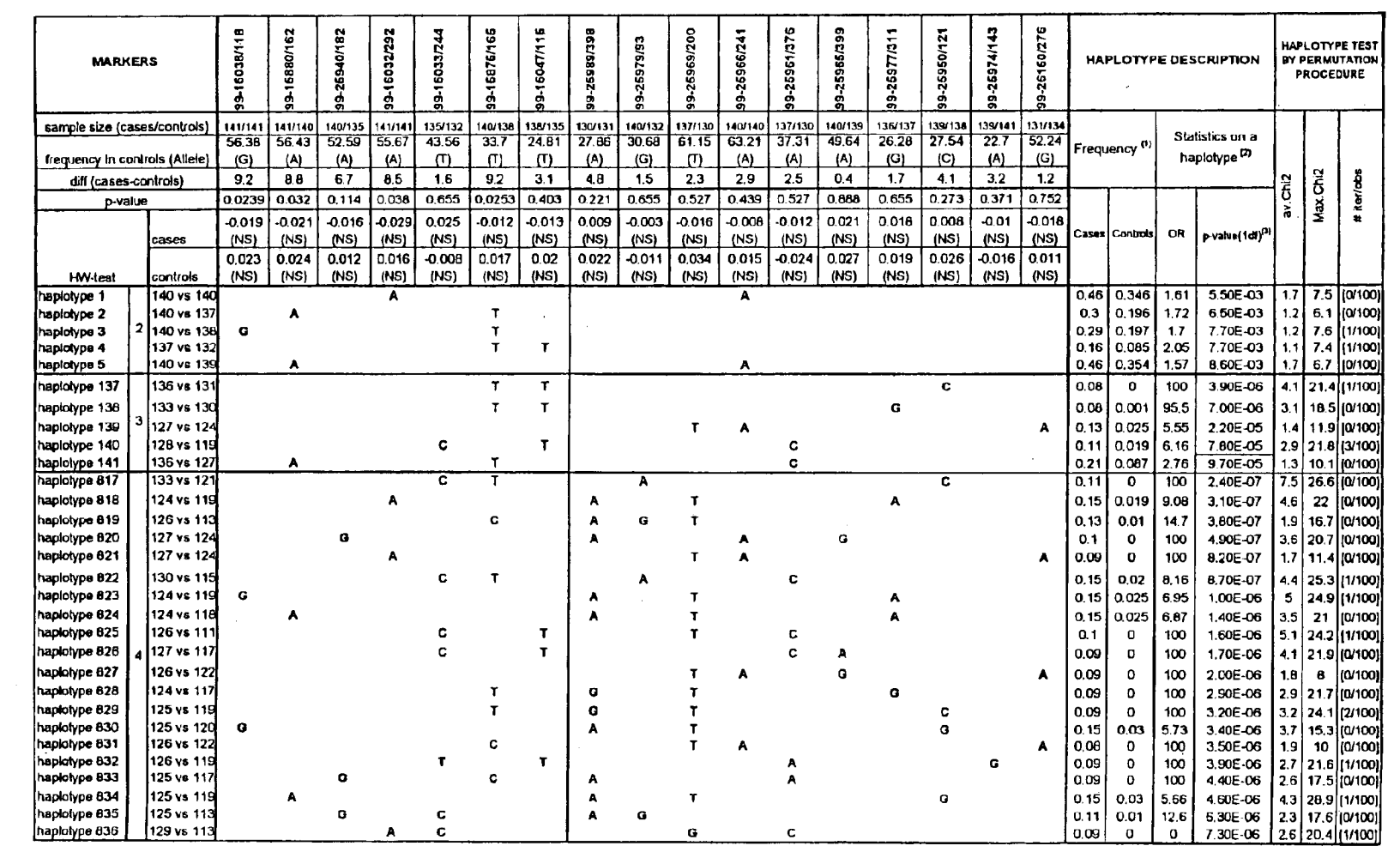

Haplotype studies yielded significant results indicating an association of the nucleotide sequences of the invention with schizophrenia. Significant results are shown in FIGS. 5 and 6, including descriptions of the frequency of the haplotype leading to the maximum chi square test (reference no. (1) in figures), the test of the frequency of a particular haplotype in cases vs in controls (reference no. (2) in figures) and the p-value assuming that the test has a chi-square distribution with 1 degree of freedom (dd1) (reference no. (3) in figures). The results of the haplotype analysis using 28 preferred biallelic markers of the invention, 99-24656-260 (A48), 99-24639-163 (A60), 99-24634-108 (A61), 99-7652-162 (A62), 99-16100-147 (A65), 99-5862-167 (A70), 99-5919-215 (A75), 99-24658-410 (A76), 99-24644-194 (A80), 99-5897-143 (A107), 99-24649-186 (A108), 99-16038-118 (A198), 99-15880-162 (A218), 99-25940-182 (A221), 99-16032-292 (A223), 99-16033-244 (A227), 99-15875-165 (A228), 99-16047-115 (A239), 99-25950-121 (A285), 99-25961-376 (A286), 99-25965-399 (A287), 99-25966-241 (A288), 99-25969-200 (A290), 99-25974-143 (A292), 99-25977-311 (A293), 99-25979-93 (A295), 99-25989-398 (A299), and 99-26150-276 (A304) are shown in FIGS. 5 and 6. FIGS. 5 and 6 also show the physical order of the biallelic markers comprising the haplotypes.

FIG. 5 shows the results of the haplotype analysis using the following biallelic markers located on the approximately 319 kb sequence of SEQ ID No. 1: 99-24656-260 (A48), 99-24639-163 (A60), 99-24634-108 (A61), 99-7652-162 (A62), 99-16100-147 (A65), 99-5862-167 (A70), 99-5919-215 (A75), 99-24658-410 (A76), 99-24644-194 (A80), 99-5897-143 (A107), 99-24649-186 (A108), 99-16038-118 (A198), 99-15880-162 (A218), 99-25940-182 (A221), 99-16032-292 (A223), 99-16033-244 (A227), 99-15875-165 (A228), and 99-16047-115 (A239).

FIG. 6 shows the results of the haplotype analysis using the following biallelic markers located on the approximately 319 kb of SEQ ID No. 1 as well as additional biallelic markers located on the human chromosome 13q31-q33 locus: 199-16038-118 (A198), 99-15880-162 (A218), 99-25940-182 (A221), 99-16032-292 (A223), 99-16033-244 (A227), 99-15875-165 (A228), 99-16047-115 (A239), 99-25950-121 (A285), 99-25961-376 (A286), 99-25965-399 (A287), 99-25966-241 (A288), 99-25969-200 (A290), 99-25974-143 (A292), 99-25977-311 (A293), 99-25979-93 (A295), 99-25989-398 (A299), and 99-26150-276 (A304).

A number of biallelic marker haplotypes were shown to be significantly associated with schizophrenia.

Several preferred haplotype all showing highly significant association with schizophrenia and including various 2-, 3- and 4-marker haplotypes are haplotypes 817, 818 and 819, 137, 138, 1 and 2 of FIG. 6, and haplotypes 970, 154 and 1 of FIG. 5. The p-values, odd-ratios and estimated haplotype frequencies are further described in FIGS. 5 and 6. In particular, the two marker haplotype 1 of FIG. 5 consisting of biallelic markers 99-5862-167 (A70) and 99-15875-165 (A228) showed a highly significant p-value of $7.8 \times 10^{-5}$ and an odd-ratio of 1.61. Haplotype 818 of FIG. 6 consisting of four biallelic markers (99-16032-292 (A223), 99-25969-200 (A290), 99-25977-311 (A293), and 99-25989-398 (A299)) presented a p-value of $3.1 \times 10^{-7}$ and an odd-ratio of 9.08. Another example showing significance is haplotype 817 of FIG. 6 consisting of four biallelic markers (99-16033-244 (A227), 99-15875-165 (A228), 99-25950-121 (A285) and 99-25979-93 (A295)), presented a p-value of $2.4 \times 10^{-7}$ and an odd-ratio of 100. Phenotypic permutation tests confirmed the statistical significance of these results. Estimated haplotype frequencies were 10.5% in cases and 0% in the controls. Haplotype 970 of FIG. 5 consisting of four biallelic markers (99-5919-215 (A75), 99-24658-410 (A76), 99-15875-165 (A228), and 99-16047-115 (A239)) presented a p-value of $7.8 \times 10^{-7}$ and an odd-ratio of 2.41. Phenotypic permutation tests confirmed the statistical significance of these results. Estimated haplotype frequencies were 25.7% in cases and 12.5% in the controls.

Several other significant haplotypes are listed in FIGS. 5 and 6, including several 2-, 3- and 4-marker haplotypes. Considered to be highly significantly associated with schizophrenia are the most significant 2-marker haplotypes (for example haplotype 1 of FIG. 5 noted above and the most significant 3-marker haplotypes (for example haplotype 137 of FIG. 6 consisting of biallelic markers (99-15875-165 (A228), 99-16047-115 (A239) and 99-25950-121 (A285)).

Further preferred significant haplotypes considered associated with schizophrenia are haplotypes having p-values above a desired threshold level; all the haplotypes listed in FIGS. 5 and 6 present p-values below $1.0 \times 10^{-2}$ for 2-marker haplotypes, $1.0 \times 10^{-4}$ for 3-marker haplotypes, and $1.0 \times 10^{-5}$ for 4-marker haplotypes. FIGS. 5 and 6 show several 2-marker haplotypes, haplotypes 1 to 9 and haplotypes 1 to 5 of FIGS. 5 and 6 respectively, having p-values ranging from $1.0 \times 10^{-5}$ to $8.6 \times 10^{-3}$, several 3-marker haplotypes, haplotypes 154 to 163 and 137 to 141 of FIGS. 5 and 6 respectively, having p-values ranging from $3.9 \times 10^{-6}$ to $1.1 \times 10^{-4}$ and several 4-marker haplotypes, haplotypes 970 to 973 and 817 to 836 of FIGS. 5 and 6 respectively, having p-values ranging from $2.4 \times 10^{-7}$ to $7.3 \times 10^{-6}$.

Additionally, a particularly large number of the significant 2-, 3- and 4-marker haplotypes often comprised the biallelic markers A223, A76, A227, A239, A286, A290, A299 and most commonly A228 (99-15875-165), allele T.

The statistical significance of the results obtained for the haplotype analysis was evaluated by a phenotypic permutation test reiterated 100 times on a computer. For this computer simulation, data from the affected and control individuals were pooled and randomly allocated to two groups which contained the same number of individuals as the case-control populations used to produce the data summarized in FIGS. 5 and 6. A haplotype analysis was then run on these artificial groups for the markers included in the haplotypes showing strong association with schizophrenia. This experiment was reiterated 100 times and the results are shown in the columns of FIGS. 5 and 6 labelled "Haplotype test by permutation procedure". For a given haplotype, these results demonstrate the number of obtained (simulated) haplotypes having a p-value comparable to the one obtained for the given haplotype among 100 iterations. These results, set forth in FIGS. 5 and 6 validate the statistical significance of the association between the haplotypes and schizophrenia.

Example 5c

Association Study Between Schizophrenia and the Biallelic Markers of the Invention in French Canadian Samples Collection of DNA Samples from Affected and Non-affected Individuals Biallelic markers of the present invention were further genotyped in French Canadian samples as described above in order to compare the association of the 1st and the 2nd portion of Region D with schizophrenia. The population used in the study was the same as described above with the exception that 2 male FH+ cases were not included.

The biallelic markers analyzed in the study include 34 preferred biallelic markers of the invention located in Region D of the chromosome 13q31-33 region. Included in the analysis were the 14 following biallelic markers from the first of two portions of Region D: 99-26150/276 (A304), 99-26156/290 (A307), 99-26153/44 (A305), 99-25985/194 (A298), 99-25974/143 (A292), 99-25977/311 (A293), 99-25972/317 (A291), 99-25965/399 (A287), 99-25961/376 (A286), 99-25966/241 (A288), 25967/57 (A289), 99-25969/200 (A290), 99-25979/93 (A295) and 99-25989/398 (A299). Included in the analysis were also the 20 following biallelic markers from the second of two portions of Region D: 99-25993/367 (A241), 99-16047/115 (A239), 99-15875/165 (A228), 99-16033/244 (A227), 99-16032/292 (A223), 99-25940/182 (A221), 99-15880/162 (A218), 99-16038/118 (A198), 99-15870/400 (A178), 99-24649/186 (A108), 99-5897/143 (A107), 99-24644/194 (A80), 99-24658/410 (A76), 99-5919/215 (A75), 99-5862/167 (A70), 99-16100/147 (A65), 99-7652/162 (A62), 99-24634/108 (A61), 99-24639/163 (A60) and 99-24656/260 (A48).

Single Biallelic Marker Association Results in Schizophrenia Cases

Single biallelic marker studies yielded significant results, indicating an association of the nucleotide sequences of the invention with schizophrenia. Biallelic markers used in the analysis included the set of 34 biallelic markers shown in Table 11 below, 14 biallelic markers of which were located on the first of two portions of Region D, and 20 of which were located on the second portion. The distribution of markers in shown in Table 12 below. As summarized in Table 13, analyses using these biallelic markers demonstrated a significant association with schizophrenia for 5 markers on the second portion of Region D.

TABLE 11

| REGION | CONTIG | SNPS GENOTYPED | POLY-MORPHISM | FREQUENCY IN CONTROLS |
|---|---|---|---|---|
| D | 1st portion | 99-26150/276 | A/G | 50 |
| | | 99-26156/290 | A/C | 69 |
| | | 99-26153/44 | A/C | 61 |
| | | 99-25985/194 | C/T | 29 |
| | | 99-25974/143 | A/G | 25 |
| | | 99-25977/311 | A/G | 73 |
| | | 99-25972/317 | C/T | 72 |
| | | 99-25965/399 | A/G | 49 |
| | | 99-25961/376 | A/C | 40 |
| | | 99-25966/241 | A/G | 63 |
| | | 99-25967/57 | A/G | 43 |
| | | 99-25969/200 | G/T | 40 |
| | | 99-25979/93 | A/G | 72 |
| | | 99-25989/398 | A/G | 29 |
| | 2nd portion | 99-25993/367 | A/G | 44 |
| | | 99-16047/115 | C/T | 73 |
| | | 99-15875/165 | C/T | 63 |
| | | 99-16033/244 | C/T | 54 |
| | | 99-16032/292 | A/C | 58 |
| | | 99-25940/182 | A/G | 53 |
| | | 99-15880/162 | A/G | 58 |
| | | 99-16038/118 | A/G | 42 |
| | | 99-15870/400 | A/G | 33 |
| | | 99-24649/186 | C/T | 65 |
| | | 99-5897/143 | A/C | 59 |
| | | 99-24644/194 | A/G | 39 |
| | | 99-24658/410 | C/T | 58 |
| | | 99-5919/215 | A/G | 60 |
| | | 99-5862/167 | C/T | 51 |
| | | 99-16100/147 | A/G | 50 |
| | | 99-7652/162 | A/G | 52 |
| | | 99-24634/108 | A/T | 53 |
| | | 99-24639/163 | G/T | 44 |
| | | 99-24656/260 | A/G | 54 |

TABLE 12

| Region | No. of Biallelic markers (σ) | Mean frequency (σ) | Mean inter-marker distance (σ) |
|---|---|---|---|
| D 1st half | 14 (14) | 0.34 (0.07) | 7 (6.3) |
| D 2nd half | 20 (8) | 0.42 (0.06) | 11 (13) |
| D 1st and 2nd half | 34 (22) | 0.39 (0.07) | 10.3 (11) |

Haplotype Frequency Analysis

Haplotype analysis for association of chromosome 13q31-q33-related biallelic markers and schizophrenia was performed by estimating the frequencies of all possible 2, 3 and 4 marker haplotypes in the affected and control populations described above. Haplotype estimations were performed by applying the Expectation-Maximization (EM) algorithm (Excoffier and Slatkin, 1995), using the EM-HAPLO program (Hawley et al., 1994) as described above.

Haplotype Association Results in Schizophrenia Cases

Significant results were also obtained in haplotype studies indicating an association of the nucleotide sequences of the invention with schizophrenia.

The present inventors having previously demonstrated highly significant association of biallelic markers located on the Region D subregion of the human chromosome 13q31-q33 locus with disease. Using the Omnibus LR test which compares the profile of haplotype frequencies, and Haplo-maxM test which is based on haplotype differences for each haplotype in two groups, FIGS. 7 and 8 describe the results of an analysis of the first and second portions of Region D which demonstrated an association of the second portion of Region D with schizophrenia.

For combinations of 2 and 3 biallelic markers, one likelihood ratio test is obtained based on the haplotype frequency values calculated using the E-M algorithm. A permutation procedure was used, where data from the affected and control individuals was pooled and randomly allocated to two groups which contained the same number of individuals as the case-control populations used to produce the data. A haplotype analysis was then run on these artificial groups for the markers included in the haplotypes showing strong association with schizophrenia. This experiment was reiterated 100 times. For a given haplotype, these results demonstrate the number of obtained (simulated) haplotypes having a p-value comparable to the one obtained for the given haplotype among 100 iterations.

FIG. 7 shows a comparison of the LR test value distributions of haplotype frequencies in the two portions of Region D. This association of the second portion of Region D with schizophrenia is shown using both 2-marker and 3-marker combinations. The distribution of LR test values in the different regions was analyzed using a Kruskal-Wallis rank test, a chi-square test with r-1 degrees of freedom, where r represents the number of value sets compared. As shown, the significance of the association is demonstrated by a chi-square value (one degree of freedom) of 74.405 and a p-value of less than $1 \times 10^{-10}$ for 2 marker combinations, and a chi-square value (one degree of freedom) of 228.72 and a p-value of $1 \times 10^{-10}$ for 3-marker combinations.

Another association analysis approach based on haplotype frequency differences, referred to as the Haplo-maxM test, was conducted using region D biallelic markers. For one combination of markers having h haplotypes, h differences of haplotype frequencies can be compared via a Pearson chi-square statistic (one degree of freedom). The haplo-max test selects the difference showing the maximum positive test value between cases versus controls (rejecting test values based on rare haplotype frequencies, i.e., with an estimated number of haplotypes inferior to 10); for one combination of markers there is therefore one Max-M test value. The results of the Haplo-maxM test using Region D biallelic markers are shown in FIG. 8.

Figure 8B:
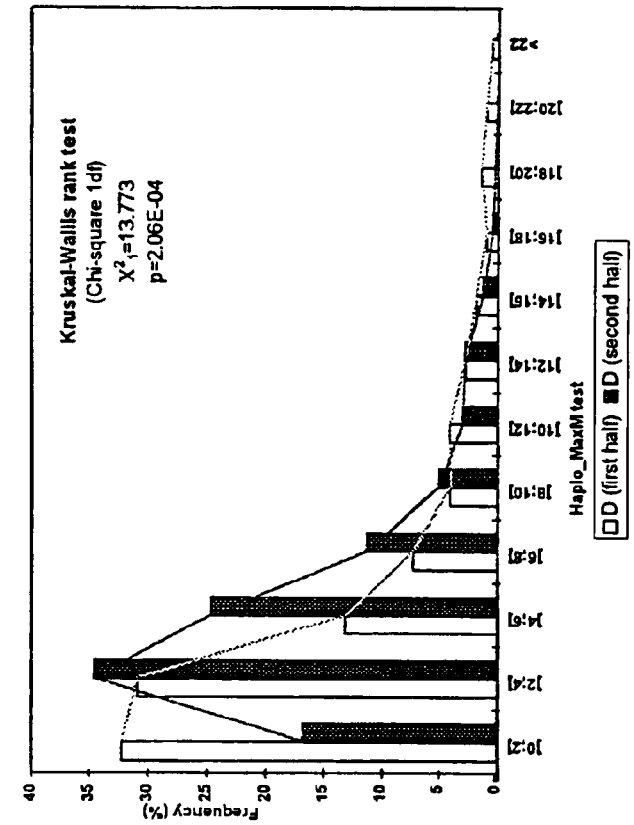
FIGS. 8A and 8B show the results of a haplotype association analysis (HaplotMaxM test value distribution) between schizophrenia cases and haplotypes comprising Region D biallelic markers of the invention.
Figure 8A:
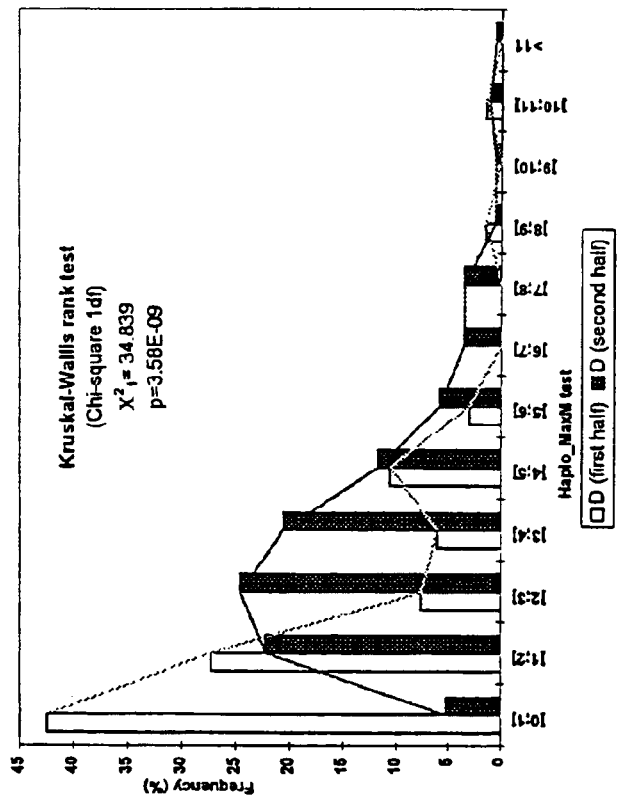

FIG. 8 shows the distribution of haplo-maxM test values obtained for both 2-marker and 3-marker combinations in the two portions of Region D, demonstrating an association of the second portion of Region D with schizophrenia. The comparison of the distribution of Haplo-maxM test values on the two regions was analyzed using a Kruskal-Wallis rank test, a chi-square test with r-1 degrees of freedom, where r represents the number of value sets compared. As shown, the significance of the association is demonstrated by a chi-square value (one degree of freedom) of 34.839 and a p-value of less than $3.58 \times 10^{-9}$ for 2 marker combinations, and a chi-square value (one degree of freedom) of 13.773 and a p-value of $2.6 \times 10^{-4}$ for 3-marker combinations.

The results from the haplo-maxM tests further confirms the association shown using the Omnibus LR test results.

Results of association studies discussed above using biallelic markers of the invention are further summarized in Table 13 below, showing a significant association of the biallelic markers with schizophrenia in both single biallelic marker and haplotype analysis.

TABLE 13

| | Single point Analysis | | Multi-point analysis | | |
|---|---|---|---|---|---|
| | No. of allelic freq dif-ferences > 10% | No. Significant allelic tests | (Haplotype-based analysis) Omnibus LR TEST* | | |
| | | | 2-mks | 3-mks | 4-mks |
| Region D, 1st portion | 0 | 0 | 0.03 | 0.05 | 0.06 |
| Region D, 2nd portion | 0 | 5 | 0.30 | 0.30 | 0.31 |

*percentage of significant tests (5% level of significance)
Cases (N = 213)/Controls (N = 241)

Example 5d

Association Study Between Bipolar Disorder and the Biallelic Markers of the Invention Description of Study Design Biallelic markers of the invention were analyzed in bipolar disorder cases. As in examples above, single and multi-point analyses showed a significant association of the markers of the invention, of Region D of the chromosome 13q33 locus, and more particularly of a sub-region of Region D with bipolar disorder.

A) Description of the Affected Population

All the samples were collected from a study of bipolar disorder undertaken in a hospital located south of Buenos Aires, Argentina, generally representing a population estimated at about 400,000 inhabitants. Patients were evaluated by four doctors in 1994 and 1995. The study design involved in the ascertainment of cases and their first degree relatives (parents or siblings). 514 individuals were available for the study. This group consisted of 158 subjects from 51 different families, and 356 independent subjects.

As a whole, bipolar disorder cases were ascertained according to the diagnosis of bipolar disorder established by the DSM-IV (Diagnostic and Statistical Manual, Fourth edition, Revised 1994, American Psychiatric Press);

Available for consideration for each coded case were also age, sex, nationality of parents and grand parents, ethnic origin, familial composition, marital state, socio-economic level, educational level, professional situation, employment, receational activities, age of onset of phychiatric symptoms, age of first consultation, occurrences of obstetric or prenatal incidents, suicide attempts, other medical conditions, treatment for or occurrence of a neurological condition, familial occurrence of symptoms, previous or concurrent use of psychotropic drugs, other admissions to a hospital or medical treatments, and diagnostic reason for admission including (a) DSM-IV diagnosis and (b) symptoms first presented on admission to hospital.

Available for study were 226 bipolar disorder ascertained cases of which 203 were independent cases. This group consisted of 51 cases from 51 families, 20 cases in relatives thereof, and 155 independent cases. Upon elimination of 3 cases from the initial independent 155 cases due to discovery of a familial relation, the total number of independent cases was 203.

Cases were classified according to bipolar disorder type. The cases included 115 bipolar disorder type I individuals (including 1 rapid cycling case), 67 bipolar disorder type II individuals (including 1 rapid cycling case), 18 unclassified bipolar disorder cases, and 3 cases which remained unclassified due to lack of or inconsistent information.

The 203 independent cases were examined for a familial history of psychosis. 53 of these cases reported an occurrence of psychosis (characterized as schizophrenia or bipolar disorder) among first degree relatives (father, mother, brothers, sisters or children).

B) Description of the Unaffected Population

Available for study were 201 controls which had not been affected by any psychiatric difficulties or reported any familial history of psychiatric difficulties. Available for consideration were also age, sex and ethnic origin of the unaffected population.

C) Case and Control Populations Selected for the Association Study

For the association study, the case population under study consisted of 201 individuals selected from the 226 total cases above; the control population consisted of 198 individuals selected from the 201 controls described above.

The association data that are presented in the Example 5d below were obtained on a population size detailed in Table 14 below.

TABLE 14

| | Sample type | |
|---|---|---|
| Cases and Control Populations | Cases Sample size | Controls |
| Selected for the Association Study | 201 | 198 |
| Gender | | |
| Male | 68 | 81 |
| Female | 124 | 117 |
| Missing | 9 | |
| Ethnic origin | | |
| Causasian | 182 | 177 |
| Non caucasian | 5 | 21 |
| Missing | 14 | |
| Familial history of psychosis (FH)* | | |
| positive (FH+) | 54 | 0 |
| none (FH−) | 147 | 198 |

*close relatives (first degree)

Both case and control populations form two groups, each group consisting of unrelated individuals that do not share a known common ancestor.

Genotyping of Affected and Control Individuals

The general strategy was to individually scan the DNA samples from all individuals in each of the populations described above in order to establish the allele frequencies of biallelic markers, and among them the biallelic markers of the invention, in the diploid genome of the tested individuals belonging to each of these populations.

Allelic frequencies of every biallelic marker in each population (cases and controls) were determined by performing microsequencing reactions on amplified fragments obtained by genomic PCR performed on the DNA samples from each individual. Genomic PCR and microsequencing were performed as detailed above in Examples 1 to 3 using the described PCR and microsequencing primers.

Association Analysis

The association analysis included 30 preferred biallelic markers of the invention located in Region D of the chromosome 13q31-33 region. Included in the analysis were the 14 following biallelic markers from the first of two subjective portions of Region D: 99-26150/276 (A304), 99-26156/290 (A307), 99-26153/44 (A305), 99-25985/194 (A298), 99-25974/143 (A292), 99-25977/311 (A293), 99-25972/317 (A291), 99-25965/399 (A287), 99-25961/376 (A286), 99-25966/241 (A288), 25967/57 (A289), 99-25969/200 (A290), 99-25979/93 (A295) and 99-25989/398 (A299). Included in the analysis were also the 16 following biallelic markers from the second of two portions of Region D: 99-25993/367 (A241), 99-16047/115 (A239), 99-15875/165 (A228), 99-16033/244 (A227), 99-16032/292 (A223), 99-25940/182 (A221), 99-15880/162 (A218), 99-16038/118 (A198), 99-15870/400 (A178), 99-24649/186 (A108), 99-5897/143 (A107), 99-24644/194 (A80), 99-5919/215 (A75), 99-5862/167 (A70), 99-16100/147 (A65), and 99-7652/162 (A62).

A) Single Biallelic Marker Association Results in Bipolar Disorder Cases

For each allele of the biallelic markers included in this study, the difference between the allelic frequency in the unaffected population and in the population affected by bipolar disorder was calculated and the absolute value of the difference was determined. The set of biallelic markers and their allelic frequencies included in this study are set forth in Table 15. The more the difference in allelic frequency for a particular biallelic marker or a particular set of biallelic markers, the more probable an association between the genomic region harboring this particular biallelic marker or set of biallelic markers and bipolar disorder. Allelic frequencies were also useful to check that the markers used in the haplotype studies meet the Hardy-Weinberg proportions (under random mating assumptions)

TABLE 15

| REGION | CONTIG | POSITION ON CONTIG | SNPS GENOTYPED | POLYMORPHISM | FREQUENCY IN CONTROLS |
|---|---|---|---|---|---|
| D | Region D first Half | 168.02 | 99-26150/276 | A/G | 62.93 |
| | | 173.29 | 99-26156/290 | A/C | 72.42 |
| | | 177.01 | 99-26153/44 | A/C | 52.66 |
| | | 186.41 | 99-25985/194 | C/T | 28.87 |
| | | 190.15 | 99-25974/143 | A/G | 31.79 |
| | | 216.43 | 99-25977/311 | A/G | 63.82 |
| | | 224.62 | 99-25972/317 | C/T | 72.32 |
| | | 236.64 | 99-25965/399 | A/G | 58.24 |
| | | 244.82 | 99-25961/376 | A/C | 44.35 |
| | | 254.70 | 99-25966/241 | A/G | 66.18 |
| | | 257.85 | 99-25967/57 | A/G | 42.44 |
| | | 261.23 | 99-25969/200 | G/T | 35.76 |
| | | 263.67 | 99-25979/93 | A/G | 67.15 |
| | | 269.39 | 99-25989/398 | A/G | 35.88 |
| | Region D second Half | 299.02 | 99-25993/367 | A/G | 47.38 |
| | | 303.04 | 99-16047/115 | C/T | 69.01 |
| | | 335.02 | 99-15875/165 | C/T | 61.3 |
| | | 354.81 | 99-16033/244 | C/T | 50.3 |
| | | 366.51 | 99-16032/292 | A/C | 62.87 |
| | | 367.14 | 99-25940/182 | A/G | 54.39 |
| | | 372.98 | 99-15880/162 | A/G | 62.72 |
| | | 375.28 | 99-16038/118 | A/G | 37.29 |
| | | 383.41 | 99-15870/400 | A/G | 29.65 |
| | | 394.16 | 99-24649/186 | C/T | 66.57 |
| | | 395.27 | 99-5897/143 | A/C | 52.6 |
| | | 409.93 | 99-24644/194 | A/G | 38.29 |
| | | 424.95 | 99-5919/215 | A/G | 60.63 |
| | | 441.62 | 99-5862/167 | C/T | 46.53 |
| | | 444.00 | 99-16100/147 | A/G | 48.84 |
| | | 445.84 | 99-7652/162 | A/G | 49.7 |
| TOTAL | | | 30 | | |

(1): frequency (%) in caucasian controls (N = 177) of the first allele (alphabetic order) Region D was arbitrarily split in two halves (D 1st half and D 2nd half) for purpose of the analysis.

The present inventors have previously demonstrated significant association of biallelic markers located on the Region D subregion of the human chromosome 13q31-33 region with disease. Using a set of 30 biallelic markers shown in Table 15, D $1^{st}$ half contained 14 markers and D $2^{nd}$ half contained 16 markers.

Table 15 also shows the physical order of the biallelic markers on Region D of the human chromosome 13q31-q33 region. The mean intermarker distances of the biallelic markers on the first and the second subjective portions of Region D were as listed below in Table 16.

TABLE 16

| Region | Mean Inter-marker distance (std) |
|---|---|
| D 1$^{st}$ half | 7.80 (6.33) |
| D 2$^{nd}$ half | 9.79 (8.78) |
| D 1$^{st}$ and 2$^{nd}$ half | 9.58 (8.46) |

The analysis using selected Region D biallelic markers of the invention demonstrated a significant association with bipolar disorder for the second portion of Region D. The analysis was conducted using the sample population described above with 182 caucasian cases and 177 caucasian controls selected from the total case and control group.

One biallelic marker in particular, 99-15875/165(A228), located on the second half of Region D, demonstrated a significant association with disease at a significance level of better than 5% (corresponding to an absolute logarithm (p-value) of 1.3).

B) Haplotype Association Results in Bipolar Disorder Cases

Haplotype analysis for association of chromosome 13q31-q33-related biallelic markers and bipolar disorder was performed by estimating the frequencies of all possible 2, 3 and 4 marker haplotypes in the affected and control populations described above. Haplotype frequencies estimations were performed by applying the Expectation-Maximization (EM) algorithm (Excoffier and Slatkin, 1995), modified by Nicholas Schork.

Significant results were obtained in haplotype studies indicating an association of the nucleotide sequences of the invention with bipolar disorder. The haplotype analysis as shown in the FIGS. 9A, 9B, 10A, 10B, 11A and 11B was conducted using the sample population described above, using 182 caucasian cases and 177 caucasian controls selected from the total case and control group.

Using the Omnibus LR test which compares the profile of haplotype frequencies, and Haplo-maxM test which is based on haplotype frequencies differences for each haplotype in two groups, FIGS. 9A, 9B, 10A, 10B, 11A and 11B show the results of a comparison of the first and second portions of Region D which demonstrated an association of the second portion of Region D with bipolar disorder.

a—Omnibus LR Tests Values

For a given combination of 2, 3 or 4 biallelic markers, one likelihood ratio test (LR test) is obtained based on the haplotype frequencies values calculated using the E-M algorithm.

Figure 9A:
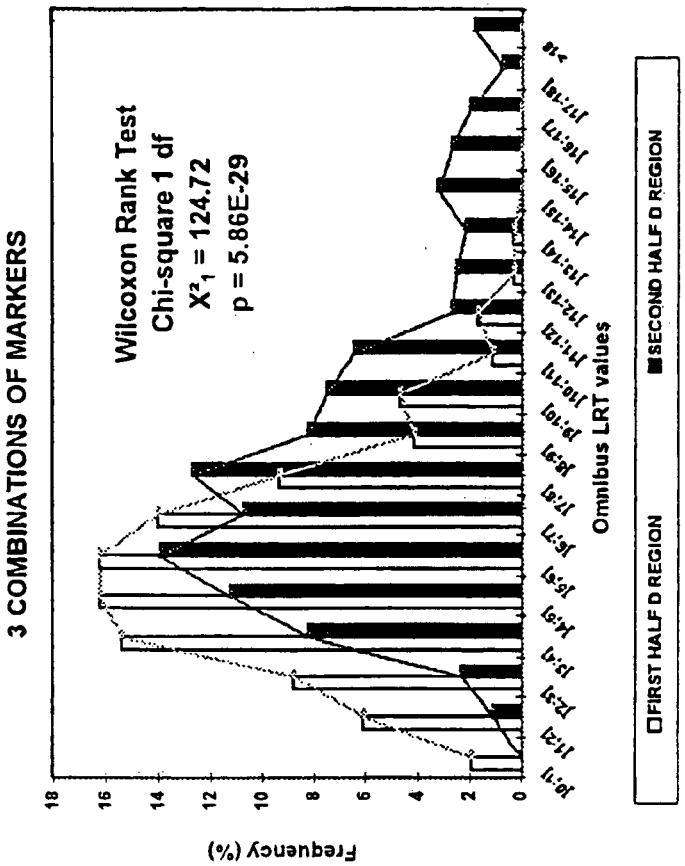
FIGS. 9A and 9B show the results of a haplotype association analysis (Omnibus LR test value distribution) between bipolar disorder cases and haplotypes comprising Region D biallelic markers of the invention.
Figure 9B:
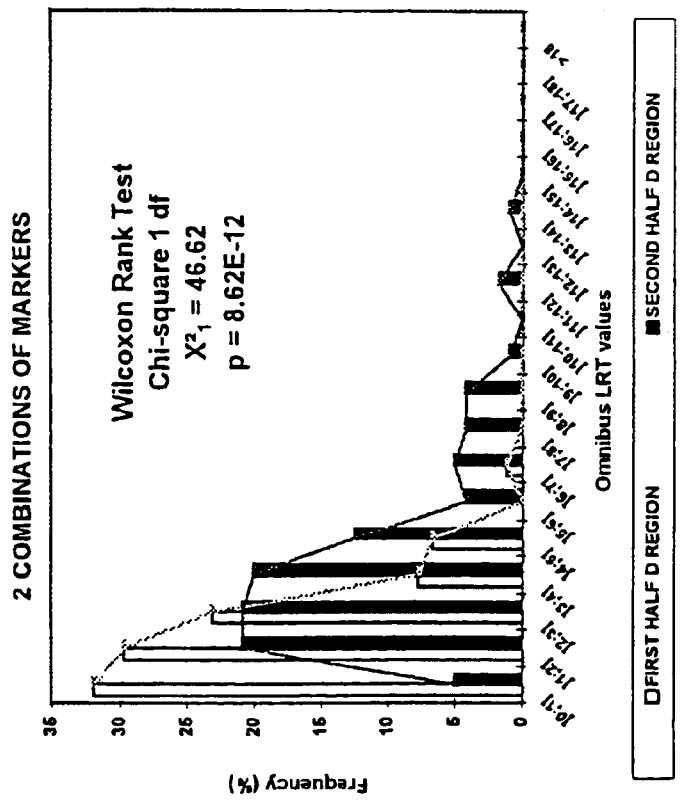

FIGS. 9A and 9B show a comparison of the LR test value distributions of haplotype frequencies in the two portions of Region D. This association of the second portion of Region D with bipolar disorder is shown using both 2-marker and 3-marker combinations. A Kruskall Wallis rank test was used to compare LR test values distributions in the two subjective portions of Region D. This test has an asymptotic Chi-square distribution, under the null hypothesis of no difference between the sets compared, with (r-1) degrees of freeedom, where r represents the number of sets compared. Here, we compare the 2 portions of region D, so r=2, and the asymptotic Chi-square distribution has 1 degree of freedom. As shown, the significance of the association is demonstrated by a chi-square value (one degree of freedom) of 46.62 and a p-value of $8.62 \times 10^{-12}$ for 2 marker combinations, and a chi-square value (one degree of freedom) of 124.72 and a p-value of $5.86 \times 10^{-29}$ for 3-marker combinations.

b—Haplo-max Tests Values

Another association analysis approach based on haplotype frequencies differences, referred to as the Haplo-max test, was conducted using region D biallelic markers. The haplo-max test selects the difference showing the maximum positive (maxM) or negative (maxS) test value between cases versus controls (rejecting test values based on rare haplotype frequencies, i.e., with an estimated number of haplotypes carriers inferior to 10); for one combination of markers there is therefore one Max-M and one Max-S test values.

Figure 10A:
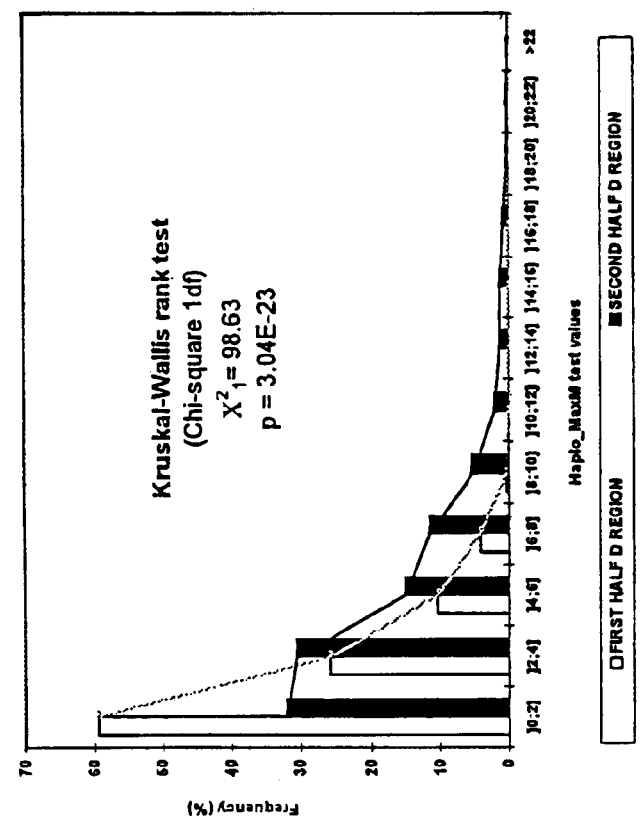
FIGS. 10A and 10B show the results of a haplotype association analysis (HaploMaxM test value distribution) between bipolar disorder cases and haplotypes comprising Region D biallelic markers of the invention.
Figure 10B:
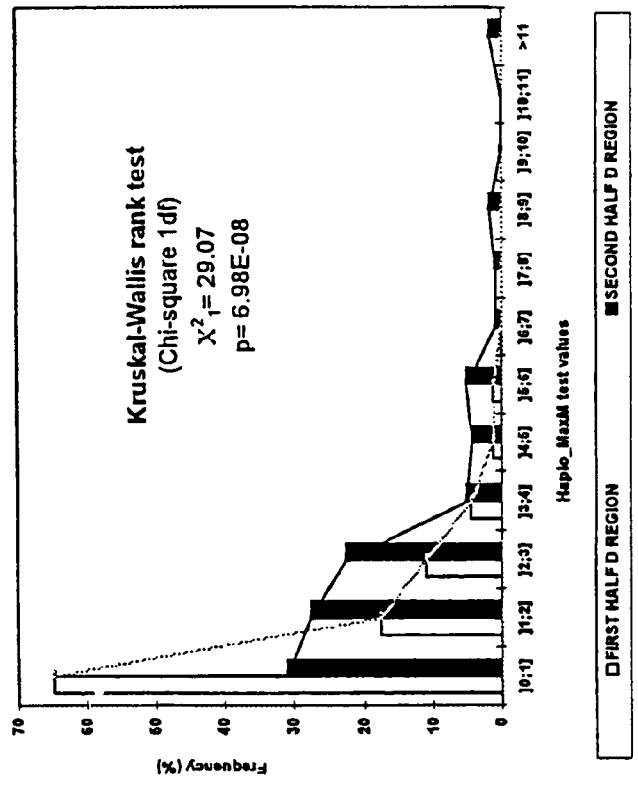

FIGS. 10A and 10B show the distribution of haplo-maxM test values obtained for both 2-marker and 3-marker combinations in the two portions of Region D, demonstrating an association of the second portion of Region D with bipolar disorder. The comparison of the distribution of Haplo-maxM test values in the two regions was analyzed using a Kruskal-Wallis rank test, a chi-square test with 1 degree of freedom. As shown, the significance of the association is demonstrated by a chi-square value of 29.07 and a p-value $6.98 \times 10^{-8}$ for 2 marker combinations, and a chi-square value of 98.63 and a p-value of $3.04 \times 10^{-23}$ for 3-marker combinations.

Figures 11A, 11B:
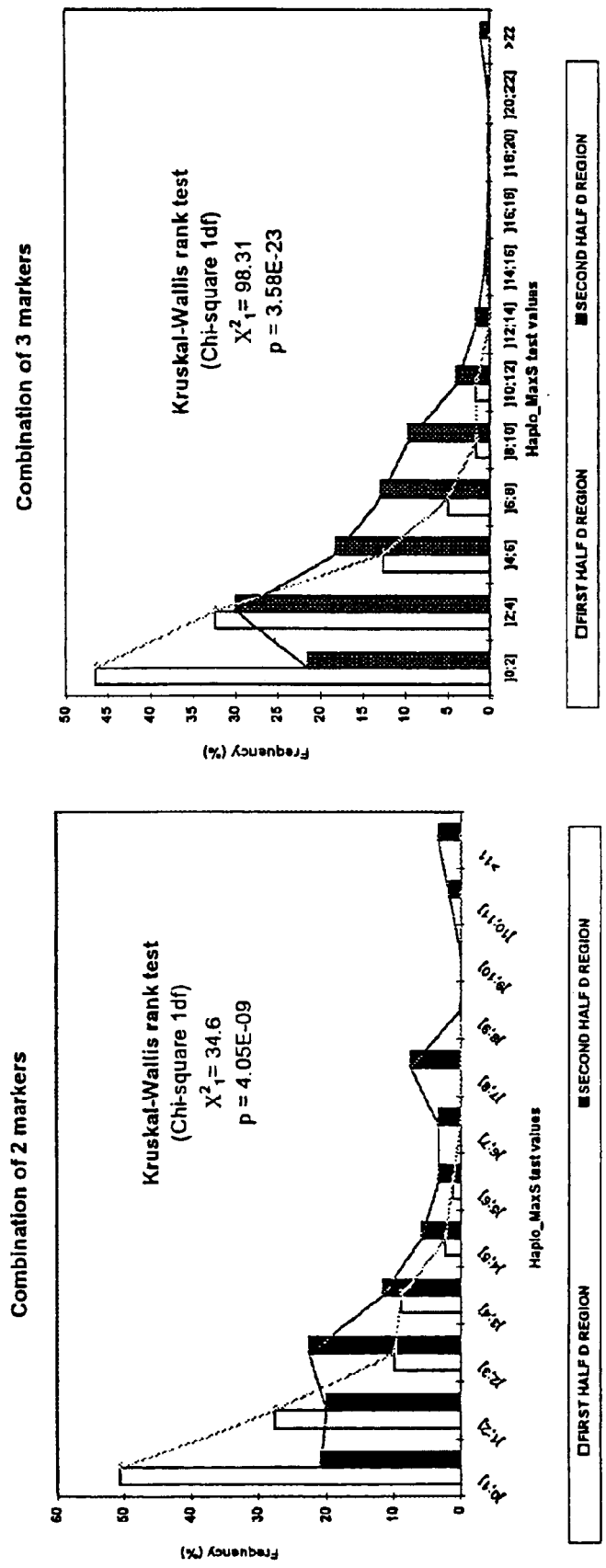
FIGS. 11A and 11B show the results of a haplotype association analysis (HaploMaxS test value distribution) between bipolar disorder cases and haplotypes comprising Region D biallelic markers of the invention.

FIGS. 11A and 11B show the distribution of Haplo-maxS test values again obtained for all 2-marker and 3-marker combinations in the two portions of Region D, demonstrating an association of the second portion of Region D with bipolar disorder. The comparison of the distributions of Haplo-maxS test values in the two portions was analyzed using a Kruskal-Wallis rank test with one degree of freedom. As shown, the significance of the association is demonstrated by a chi-square value of 34.6 and a p-value of $4.05 \times 10^{-9}$ for 2 marker combinations, and a chi-square value of 98.31 and a p-value of $3.58 \times 10^{-23}$ for 3-marker combinations.

The results from the haplo-maxM and haplo-maxS tests thus further confirm the association shown using the Omnibus LR test results.

Example 5e

Confirmation of Associations with Schizophrenia and Bipolar Disorder ("SCREENING II")

Results obtained above using French Canadian schizophrenia samples and Argentinian bipolar disorder cases were confirmed in larger screening samples and in several different populations using markers spanning Region D of the chromosome 13q31-q33 region.

In the confirmation studies, French Canadian schizophrenia samples (Algene) described above, additional United States schizophrenia samples and Argentinian bipolar disorder (Labimo) samples were analyzed in sub-regions of Region D referred to as sub-regions D1 to D4. The schizophrenia sample referred to as the Algene (or French Canadian) and the bipolar disorder sample referred to as the Labimo sample (Argentinian) are as described above. The United States schizophrenia samples are described in Table 17 below.

TABLE 17

| United States Schizophrenia Cases and Control Populations (United States Caucasians) | Sample type | |
|---|---|---|
| | Cases | Random US Controls |
| | Sample size | |
| | 131 | 188 |
| Ethnic origin | | |
| European Causasians (26 female, 66 male) | 92 | |
| Ashkenazi caucasians (7 female, 17 female) | 24 | |
| Other Caucasians (7 female, 8 male) | 15 | |
| Familial history of psychosis (FH) | | |
| positive (FH+) | 133 | |
| none (FH−) | 147 | 198 |

A set of 32 SNPs covering sub-regions D1 to D4 (mean density of 1 SNP/25 kb) was genotyped on the two different schizophrenia samples and one bipolar disorder sample. The 32 biallelic markers genotyped are shown in Table 18.

TABLE 18

| SNPs | Polymorphism | % Frequency in Algene Controls (141) |
|---|---|---|
| 99-5873/159 | C/T | 22 |
| 99-30329/380 | C/T | 48 |
| 99-15253/382 | C/T | 37 |
| 99-15280/432 | C/T | 39 |
| 99-15256/392 | C/T | 35 |
| 99-15258/337 | G/T | 24 |
| 99-27345/189 | G/C | 26 |
| 99-26150/276 | A/G | 48 |
| 99-25974/143 | A/G | 23 |
| 99-25950/121 | G/C | 28 |
| 99-25972/317 | C/T | 28 |
| 99-25965/399 | A/G | 50 |
| 99-25966/241 | A/G | 37 |
| 99-25989/398 | A/G | 28 |
| 99-16047/115 | C/T | 25 |
| 99-16052/214 | A/G | 37 |
| 99-15875/165 | C/T | 34 |
| 99-16105/152 | A/G | 46 |
| 99-16032/292 | A/C | 44 |
| 99-15880/162 | A/G | 44 |
| 99-15870/400 | A/G | 30 |
| 99-5897/143 | A/C | 39 |
| 99-24644/194 | A/G | 41 |
| 99-24658/410 | C/T | 39 |
| 99-5919/215 | A/G | 40 |
| 99-5862/167 | C/T | 49 |
| 99-24634/108 | A/T | 50 |
| 99-24656/260 | A/G | 46 |
| 99-31960/363 | A/G | 39 |
| 8-128/33 | C/T | 23 |
| 99-27935/193 | G/C | 21 |
| 99-27943/150 | G/C | 35 |

For each of the three populations, the number of significant tests in each sub-region of Region D based on single and multiple point biallelic marker analyses were compared among cases and controls. For single point analyses, excess of heterozygotes and deficiency of heterozygotes (Hardy-Weinberg disequilibrium coefficient), allelic and genotypic association analyses and logistic regression analyses were compared. For multipoint analyses, the haplotypic frequency differences between case and controls were examined, reported as MaxM for the maximum positive difference, and MaxS as the maximum negative difference, and the Omnibus LR test. The HaploMax tests giving MaxS and MaxM results and the Omnibus LR test are known and otherwise described herein. As noted in FIGS. 12 to 17, the tests containing the footnote (1) involved significance thresholds which were assessed from observed distributions, inferred taking into account the D1, D2, D3 and D4 subregions for each sub-population studied relative to the number of tests performed; for tests containing the footnote (2) in FIGS. 12 to 17, significant tests were defined as those having a significance level of 5% or better.

The present inventors have found that samples from three different populations all show a significant association to the schizophrenia trait with biallelic markers located in region D, thus confirming previous association studies with different samples and markers. Furthermore, the inventors have found in all three populations that the association is most significant in the sub-region D3. Thus, it is likely that a gene associated with schizophrenia and bipolar disorder resides in the region. The sbg1 and g35030 nucleic acid sequences described herein reside in the region D3.

In addition to results using markers in previous analyses, analyses with the 32 biallelic markers listed in Table 18 demonstrated significant results in single point analyses for several newly analyzed biallelic markers. In particular, markers 99-25974-143 (A292), 99-25972-317 (A291), 99-15870-400 (A178), 99-24656-260 (A48) demonstrated a statistically significant excess or deficiency of heterozygotes.

Schizophrenia: Algene (French Canadian)

The analysis using Algene samples compared (1) the total patients cluster of patients selected for analysis (2) cases of the cluster showing a familial history of psychosis (FH+), and (3) cases of the cluster with an absence of familial history of psychosis (FH−) to Algene control samples. Additionally, for further comparison, the number of significant tests in Region D and each of the sub-regions of Region D were compared among total cases and total controls from the screening sample of example 5b above is listed in FIG. 12 under "first screening sample". As previously reported, the original French Canadian (Algene) samples show a significant association to the schizophrenia trait with biallelic markers located in region D, both in single and multipoint analyses. Furthermore, results show that the association is clearly confined to sub-region D3 and does not extend to D2 and D4. In single point analyses, a significant concentration of biallelic markers containing the sbg1 gene presented an excess of heterozygotes for familial cases. Five of 13 (5/13) markers around sbg1 were significant for allelic association analysis.

Figure 12:
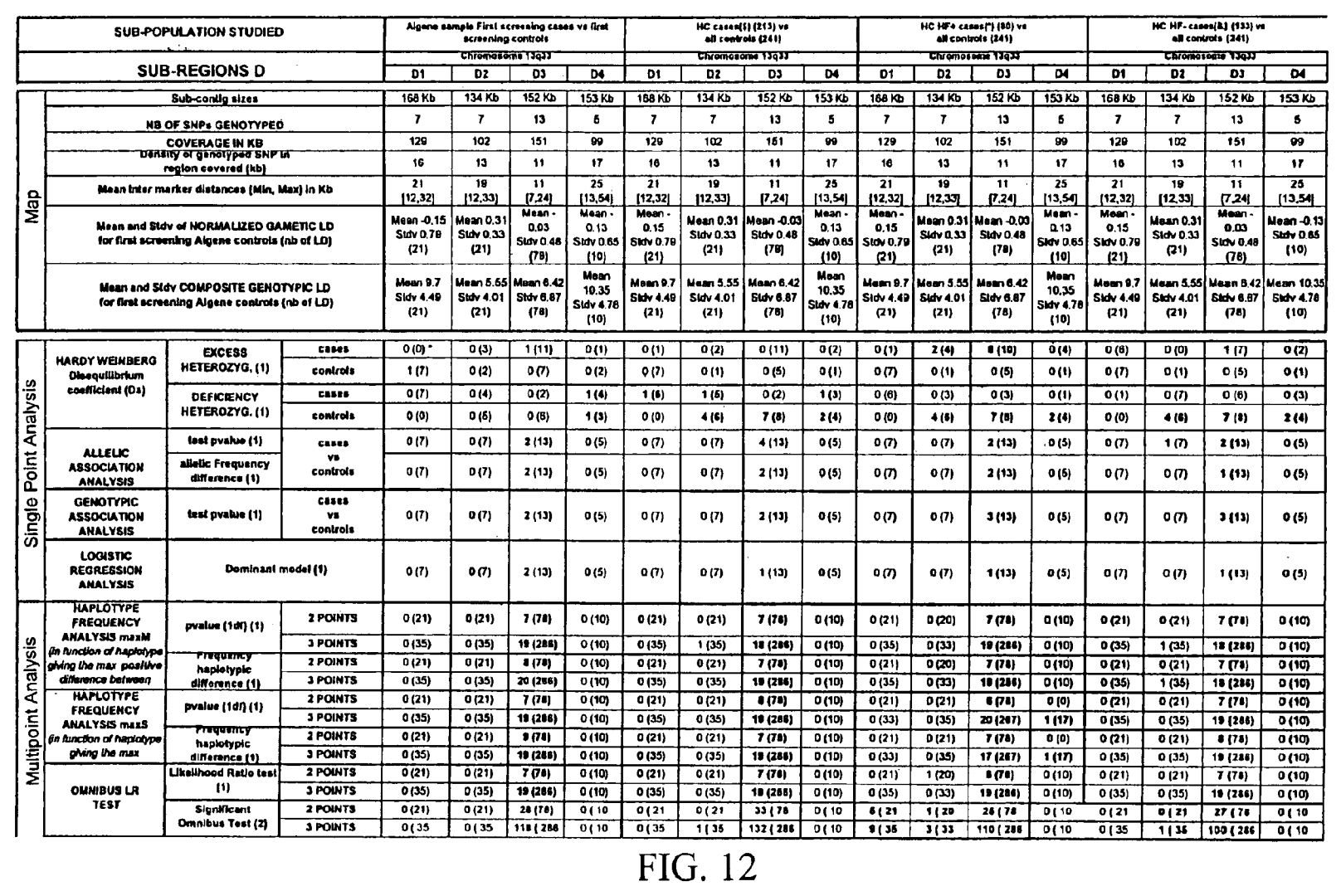

FIG. 12 provides the results from a single and multi-point biallelic marker analysis comparing regions D1, D2, D3, and D4 located in the chromosome 13q31-q33 region.

FIG. 13 shows the sum of the results shown in FIG. 12 over the larger Region D span tested (i.e. D1, D2, D3 and D4).

FIGS. 12 and 13 thus demonstrate that there is a significant association with Region D and schizophrenia in the Algene sample. Furthermore, these figures show that the number and percentage of significant tests was highest in sub-region D3 consistently across comparisons among controls and FH+, FH− and total cases. In comparing the number of significant tests in sub-region D3 among FH+ and FH− cases, the figures show that the association is more clearly observed in cases having a familial history of psychosis; single point analyses suggested a higher number of significant tests in the FH+ cases than multiple point analyses.

FIGS. 12 and 13 also show that a larger screening sample confirms the results of the smaller sample from the first screening of Algene samples, both for the larger Region D and for the sub-region D3.

Schizophrenia: United States Schizophrenia Samples

As in the French Canadian samples, the present inventors have found Region D, and more specifically sub-region D3, to be significantly associated with schizophrenia in a first, smaller screening sample of the United States Schizophrenia samples. Further analysis in the United States Schizophrenia population using a set of biallelic markers covering Region D confirms that the association of sub-region D3 with schizophrenia is of high statistical significance.

The United States Schizophrenia samples selected for the analysis consisted of the 92 European caucasians. Two analyses were performed, a first analysis using controls consisting of 188 random US controls, and a second analysis where controls consisted of 241 controls from the French Canadian samples described above.

Figure 14:
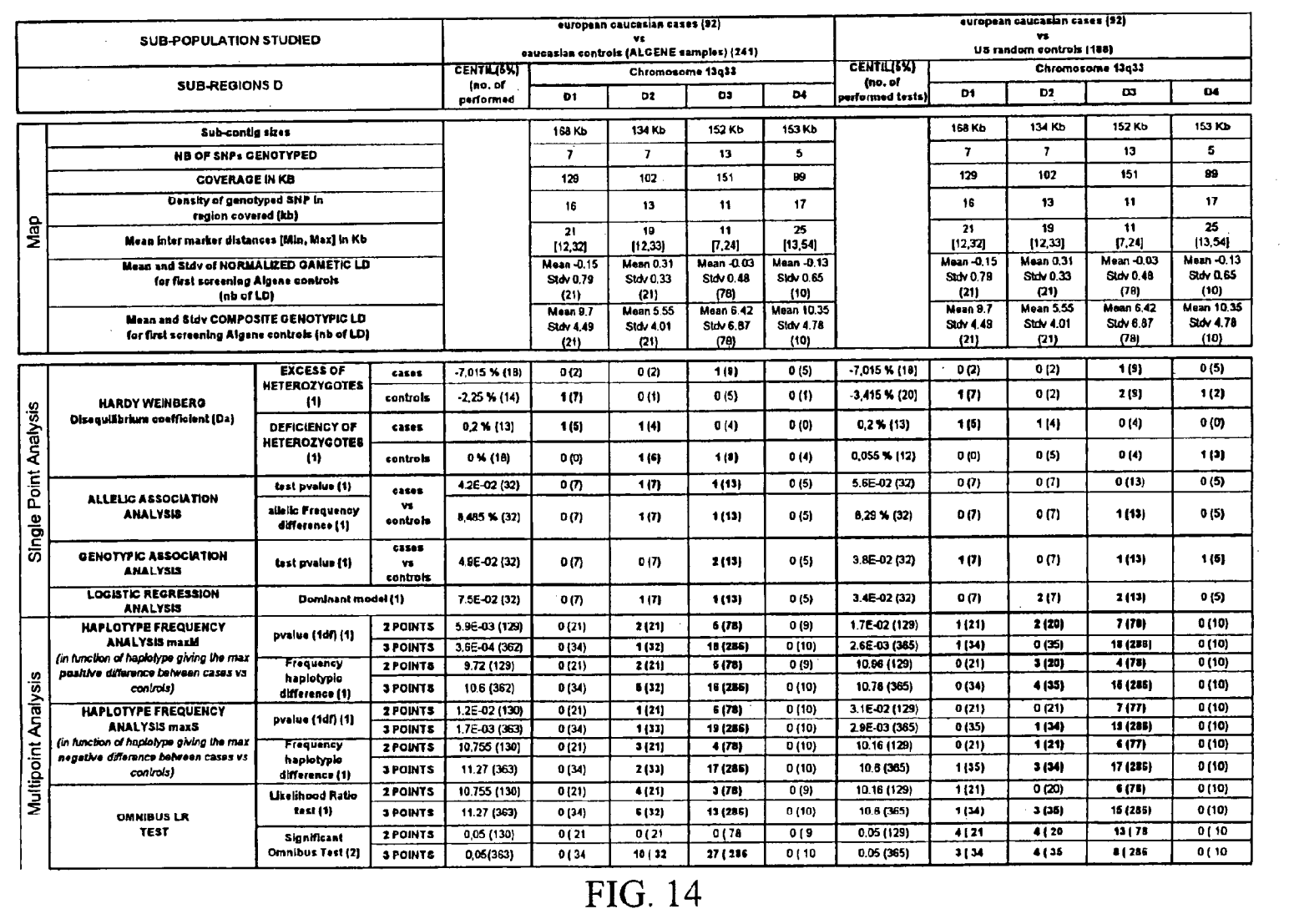

FIG. 14 provides the results from a single and multi-point biallelic marker analysis comparing regions D1, D2, D3, and D4 located in the chromosome 13q31-q33 region. FIG. 15 shows the sum of the results shown in FIG. 14 over the larger Region D span tested (i.e. D1, D2, D3 and D4).

As shown in the figures, the analysis in United States Schizophrenia samples also suggests a significant association of sub-region D2 with schizophrenia, when considering multi-point analyses. However, this association of the D2 region with schizophrenia is of lesser statistical significance than the association of schizophrenia with sub-region D3 because a lower number of tests were carried out in the D2 region. Additionally, one marker (99-5897/143) in particuar, localized in the sbg1 gene showed a significant excess of heterozygotes in schizophrenia familial cases.

In general, the number of significant tests in United States Schizophrenia samples were lower that in French Canadian population. This may be attributed to the higher heterogeneity of the United States Schizophrenia sample in comparison to the French Canadian samples. Analyses using the United States Schizophrenia samples were done using either Caucasian controls from the French Canadian samples, or US random controls.

Bipolar Disorder: Labimo (Argentinian)

As in the French Canadian and United States Schizophrenia samples, the present inventors have found Region D, and more specifically sub-region D3, to be significantly associated with bipolar disorder in Labimo samples from Argentina. Further analysis using a more extensive set of biallelic markers covering Region D confirms that the association of sub-region D3 with bipolar disorder is of high statistical significance.

Figure 16:
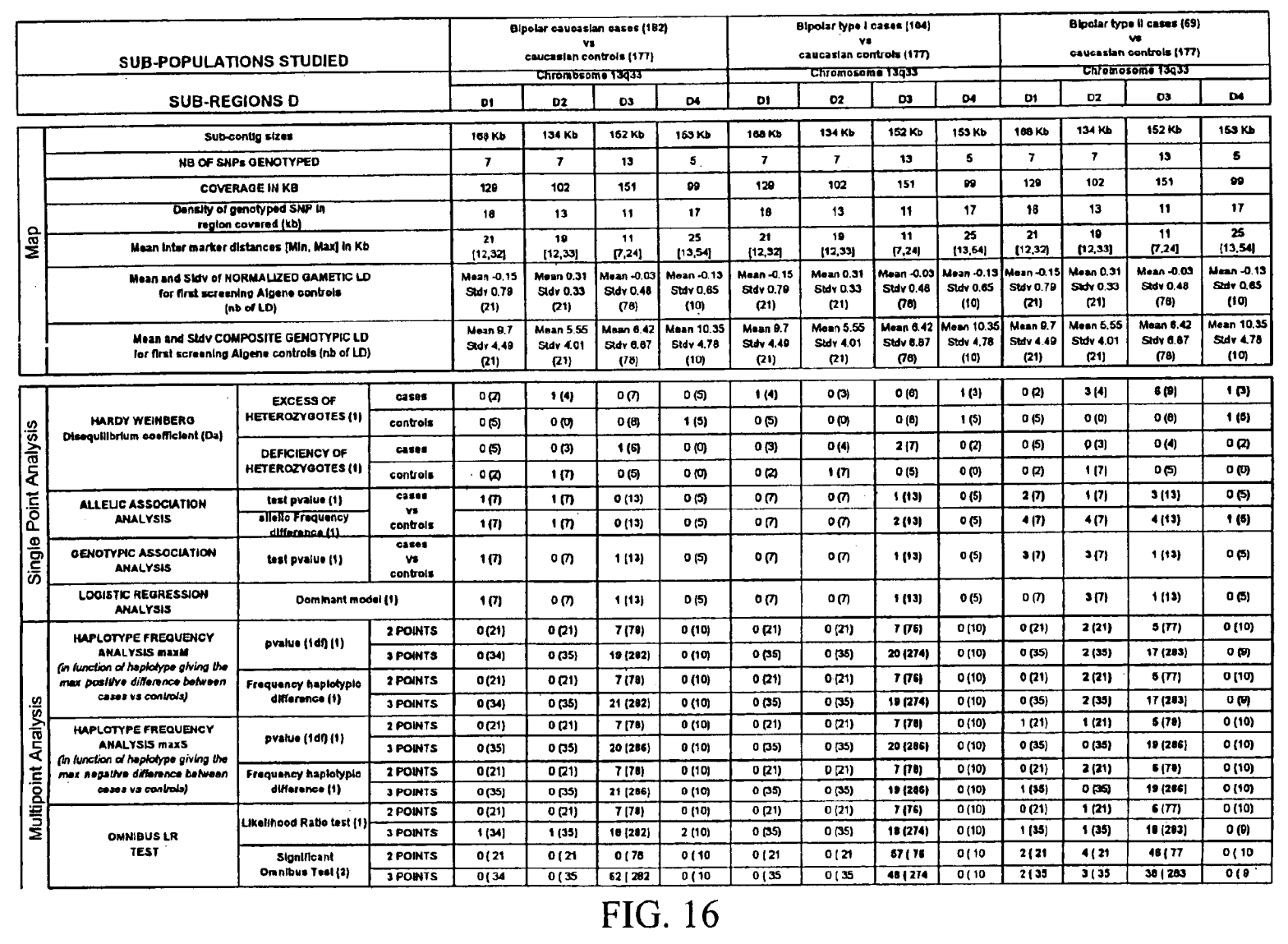

FIG. 16 provides the results from a single and multi-point biallelic marker analysis comparing regions D1, D2, D3, and D4 located in the chromosome 13q31-q33 region. FIG. 17 shows the sum of the results shown in FIG. 16 over the larger Region D span tested (i.e. D1, D2, D3 and D4). While results showed the most significant association for D3 in Labimo samples, some background signal was seen for D2. It is possible that this variance in the percentage of significant tests reflects the higher relative heterogeneity of the Labimo samples in comparison to the French Canadian samples.

FIGS. 16 and 17 thus demonstrate that there is a significant association with Region D and bipolar disorder in the Labimo sample.

Analyses of Labimo samples were also conducted separately in bipolar disorder I and bipolar disorder II cases, as shown in FIG. 16. In comparisons of results obtained with bipolar disorder I and II types, the association of sub-region D3 with schizophrenia tended to be more clearly found in bipolar disorder I cases.

Example 6

Preparation of Antibody Compositions to the sbg1 Protein

Substantially pure protein or polypeptide is isolated from transfected or transformed cells containing an expression vector encoding the sbg1 protein or a portion thereof. The concentration of protein in the final preparation is adjusted, for example, by concentration on an Amicon filter device, to the level of a few micrograms/ml. Monoclonal or polyclonal antibody to the protein can then be prepared as follows:

A. Monoclonal Antibody Production by Hybridoma Fusion

Monoclonal antibody to epitopes in the sbg1 protein or a portion thereof can be prepared from murine hybridomas according to the classical method of Kohler, G. and Milstein, C., Nature 256:495 (1975) or derivative methods thereof. Also see Harlow, E., and D. Lane. 1988. Antibodies A Laboratory Manual. Cold Spring Harbor Laboratory. pp. 53-242.

Briefly, a mouse is repetitively inoculated with a few micrograms of the sbg1 protein or a portion thereof over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, (1980), and derivative methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2.

B. Polyclonal Antibody Production by Immunization

Polyclonal antiserum containing antibodies to heterogeneous epitopes in the sbg1 protein or a portion thereof can be prepared by immunizing suitable non-human animal with the sbg1 protein or a portion thereof, which can be unmodified or modified to enhance immunogenicity. A suitable non-human animal is preferably a non-human mammal is selected, usually a mouse, rat, rabbit, goat, or horse. Alternatively, a crude preparation which has been enriched for sbg1 concentration can be used to generate antibodies. Such proteins, fragments or preparations are introduced into the non-human mammal in the presence of an appropriate adjuvant (e.g. aluminum hydroxide, RIBI, etc.) which is known in the art. In addition the protein, fragment or preparation can be pretreated with an agent which will increase antigenicity, such agents are known in the art and include, for example, methylated bovine serum albumin (mBSA), bovine serum albumin (BSA), Hepatitis B surface antigen, and keyhole limpet hemocyanin (KLH). Serum from the immunized animal is collected, treated and tested according to known procedures. If the serum contains polyclonal antibodies to undesired epitopes, the polyclonal antibodies can be purified by immunoaffinity chromatography.

Effective polyclonal antibody production is affected by many factors related both to the antigen and the host species. Also, host animals vary in response to site of inoculations and dose, with both inadequate or excessive doses of antigen resulting in low titer antisera. Small doses (ng level) of antigen administered at multiple intradermal sites appears to be most reliable. Techniques for producing and processing polyclonal antisera are known in the art, see for example, Mayer and Walker (1987). An effective immunization protocol for rabbits can be found in Vaitukaitis, J. et al. J. Clin. Endocrinol. Metab. 33:988-991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., (1973). Plateau concentration of antibody is usually in the range of 0.1 to 0.2 mg/ml of serum (about 12 µM). Affinity of the antisera for the antigen is determined by preparing competitive binding curves, as described, for example, by Fisher, D., Chap. 42 in: Manual of Clinical Immunology, 2d Ed. (Rose and Friedman, Eds.) Amer. Soc. For Microbiol., Washington, D.C. (1980).

Antibody preparations prepared according to either the monoclonal or the polyclonal protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

Example 7

Study of Effect of sbg1 Peptides on Behavior of Mice

Animals: Male C57BL6 adult mice (approximately 6 weeks old)
Peptides: sbg1 peptide:
NH2-QPLERMWTCNYNQQKDQSCNHKEITSTKAE-COOH
Control 1: NH2-REAHKSETISSKLQKEKQIKKQ-COOH
Control 2: NH2-MHMKTILGPRLGLGE-COOH
Protocol:
1. Inject mice intraperitoneally with 50 µg peptide in 200 µl sterile physiological saline (n=4/peptide).
2. Place mice in clean empty cages containing no litter, and only a small test tube rack. The cages are covered with a plastic sheet to enable taking photographs and video-tracking.
3. Observe behavior for one minute from t=5 min up to t=45 min, as indicated. Any locomoter or stereotypy movements were recorded as positive over 1 min intervals. Locomoter movements include climbing, and rearing while stereotypy movements include grooming and scratching. At the end of the experiment, the number of movements were added up for each animal.
Results:
1. Mice injected with the sbg1 peptide exhibited a decrease in the frequency of their movements over the time course of the experiment, shown in FIG. 18. This is illustrated in the left top panel of FIG. 18, where we compare the average number of movements in 3 separate time points (5, 10, and 15 min) with the average movements per min in the last period of observations (30, 35, 40, and 45 min). The sbg1 peptide also increased stereotypy—this effect was most prominent during the last period of observations. However, because the onset of stereotype was variable, we presented the data as the average of stereotypy for observations over the entire time period.

Although this invention has been described in terms of certain preferred embodiments, other embodiments which will be apparent to those of ordinary skill in the art of view of the disclosure herein are also within the scope of this invention. Accordingly, the scope of the invention is intended to be defined only by reference to the appended claims.

The disclosures of all issued patents, published PCT applications, scientific references or other publications cited herein are incorporated herein by reference in their entireties.

REFERENCES CITED

The disclosures of the following references are incorporated herein by reference in their entireties:
Abbondanzo S. J. et al. (1993) Methods in Enzymology, Academic Press, New York. pp. 803–823.
Ajioka R. S. et al. (1997) Am. J. Hum. Genet. 60:1439–1447.
Altschul et al., 1990, J. Mol. Biol. 215(3):403–410;
Altschul et al., 1993, Nature Genetics 3:266–272
Altschul et al., 1997, Nuc. Acids Res. 25:3389–3402
Anton M. et al., 1995, J. Virol., 69: 4600–4606.
Araki K et al. (1995) Proc. Natl. Acad. Sci. USA. 92(1): 160–4.
Ausubel et al. (1989) Current Protocols in Molecular Biology, Green Publishing Associates and Wiley Interscience, N.Y.
Baubonis W. (1993) Nucleic Acids Res. 21(9):2025–9.
Beaucage et al., Tetrahedron Lett 1981, 22: 1859–1862
Bradley A., (1987) Production and analysis of chimaeric mice. In: E. J. Robertson (Ed.), Teratocarcinomas and embryonic stem cells: A practical approach. IRL Press, Oxford, pp. 113.
Brown E L, Belagaje R, Ryan M J, Khorana H G, Methods Enzymol 1979;68: 109–151
Brutlag et al. Comp. App. Biosci. 6:237–245, 1990
Chai H. et al. (1993) Biotechnol. Appl. Biochem. 18:259–273.
Chee et al. (1996) Science. 274:610–614.
Chen and Kwok Nucleic Acids Research 25:347–353 1997
Chen et al. (1987) Mol. Cell. Biol. 7:2745–2752.
Chen et al., 1987, Mol. Cell. Biol., 7: 2745–2752.
Chou J. Y. (1989) Mol. Endocrinol. 3:1511–1514.
Clark A. G. (1990) Mol. Biol. Evol. 7:111–122.
Coles et al. Hum. Mol. Genet., 7:791–800, 1998
Compton J. (1991) Nature. 350(6313):91–92.
Davis et al., Basic Methods in Molecular Biology, ed., Elsevier Press, NY, 1986
Dempster et al., (1977) J. R. Stat. Soc., 39B:1–38.
Dent D. S. and Latchman D. S. (1993) The DNA mobility shift assay. In: Transcription Factors: A Practical Approach (Latchman D S, ed.) Oxford: IRL Press. pp1–26.
Eckner R. et al. (1991) EMBO J. 10:3513–3522.
Excoffier L. and Slatkin M. (1995) Mol. Biol. Evol., 12(5): 921–927.
Feldman and Steg, 1996, Medecine Sciences, synthese, 12:47–55

Flotte et al. (1992) Am. J. Respir. Cell Mol. Biol. 7:349–356.
Fodor et al. (1991) Science 251:767–777.
Fraley et al. (1979) Proc. Natl. Acad. Sci. USA. 76:3348–3352.
Fried M. and Crothers D. M. (1981) Nucleic Acids Res. 9:6505–6525.
Fuller S. A. et al. (1996) Immunology in Current Protocols in Molecular Biology, Ausubel et al. Eds, John Wiley & Sons, Inc., USA.
Furth P. A. et al. (1994) Proc. Natl. Acad. Sci USA. 91:9302–9306.
Garner M. M. and Revzin A. (1981) Nucleic Acids Res. 9:3047–3060.
Geysen H. Mario et al. 1984. Proc. Natl. Acad. Sci. U.S.A. 81:3998–4002
Ghosh and Bacchawat (1991) Targeting of liposomes to hepatocytes, IN: Liver Diseases, Targeted diagnosis and therapy using specific receptors and ligands. Wu et al. Eds., Marcel Dekeker, New York, pp. 87–104.
Gonnet et al., 1992, Science 256:1443–1445;
Gopal (1985) Mol. Cell. Biol., 5:1188–1190.
Gossen M. et al. (1992) Proc. Natl. Acad. Sci. USA. 89:5547–5551.
Gossen M. et al. (1995) Science. 268:1766–1769.
Graham et al. (1973) Virology 52:456–457.
Green et al. (1986) Ann. Rev. Biochem. 55:569–597.
Griffin et al. (1989) Science. 245:967–971.
Grompe, M. (1993) Nature Genetics. 5:111–117.
Grompe, M. et al. (1989) Proc. Natl. Acad. Sci. U.S.A. 86:5855–5892.
Gu H. et al. (1993) Cell 73:1155–1164.
Guatelli J C et al. Proc. Natl. Acad. Sci. USA. 35:273–286.
Hacia J G, Brody L C, Chee M S, Fodor S P, Collins F S, Nat Genet 1996; 14(4):441–447
Haff L. A. and Smirnov I. P. (1997) Genome Research, 7:378–388.
Hames B. D. and Higgins S. J. (1985) Nucleic Acid Hybridization: A Practical Approach. Hames and Higgins Ed., IRL Press, Oxford.
Harju L, Weber T, Alexandrova L, Lukin M, Ranki M, Jalanko A, Clin Chem 1993;39(11Pt 1):2282–2287
Harland et al. (1985) J. Cell. Biol. 101:1094–1095.
Hawley M. E. et al. (1994) Am. J. Phys. Anthropol. 18:104.
Henikoff and Henikoff, 1993, Proteins 17:49–61
Higgins et al., 1996, Methods Enzymol. 266:383–402;
Hillier L. and Green P. Methods Appl., 1991, 1: 124–8. Gu H. et al. (1994) Science 265:103–106.
Hoess et al. (1986) Nucleic Acids Res. 14:2287–2300.
Huang L. et al. (1996) Cancer Res 56(5):1137–1141.
Huygen et al. (1996) Nature Medicine. 2(8):893–898.
Izant J. G. and Weintraub H. (1984) Cell 36(4):1007–1015.
Julan et al. (1992) J. Gen. Virol. 73:3251–3255.
Kanegae Y. et al., Nucl. Acids Res. 23:3816–3821.
Karlin and Altschul, 1990, Proc. Natl. Acad. Sci. USA 87:2267–2268;
Khoury J. et al. (1993) Fundamentals of Genetic Epidemiology, Oxford University Press, NY.
Kim U-J. et al. (1996) Genomics 34:213–218.
Klein et al. (1987) Nature. 327:70–73.
Koller et al. (1992) Annu. Rev. Immunol. 10:705–730.
Kozal M J, Shah N, Shen N, Yang R, Fucini R, Merigan T C, Richman D D, Morris D, Hubbell E, Chee M, Gingeras T R, Nat Med 1996;2(7):753–759
Landegren U. et al. (1998) Genome Research, 8:769–776.
Lander and Schork, Science, 265, 2037–2048, 1994
Lenhard T. et al. (1996) Gene. 169:187–190.
Linton M. F. et al. (1993) J. Clin. Invest. 92:3029–3037.
Liu Z. et al. (1994) Proc. Natl. Acad. Sci. USA. 91: 4528–4262.
Livak et al., Nature Genetics, 9:341–342, 1995
Livak K J, Hainer J W, Hum Mutat 1994;3(4):379–385
Lockhart et al. (1996) Nature Biotechnology 14:1675–1680.
Mansour S. L. et al. (1988) Nature. 336:348–352.
Marshall R. L. et al. (1994) PCR Methods and Applications. 4:80–84.
McCormick et al. (1994) Genet. Anal. Tech. Appl. 11:158–164.
McLaughlin B. A. et al. (1996) Am. J. Hum. Genet. 59:561–569.
Morton N. E. (1955) Am. J. Hum. Genet. 7:277–318.
Muzyczka et al. (1992) Curr. Topics in Micro. and Immunol. 158:97–129.
Nada S. et al. (1993) Cell 73:1125–1135.
Nagy A. et al. (1993) Proc. Natl. Acad. Sci. USA. 90:8424–8428.
Narang S A, Hsiung H M, Brousseau R, Methods Enzymol 1979;68:90–98
Neda et al. (1991) J. Biol. Chem. 266:14143–14146.
Newton et al. (1989) Nucleic Acids Res. 17:2503–2516.
Nickerson D. A. et al. (1990) Proc. Natl. Acad. Sci. U.S.A. 87:8923–8927.
Nicolau et al. (1982) Biochim. Biophys. Acta. 721:185–190.
Nyren P, Pettersson B, Uhlen M, Anal Biochem 1993;208 (1):171–175
O'Reilly et al. (1992) Baculovirus Expression Vectors: A Laboratory Manual. W. H. Freeman and Co., New York.
Ohno et al. (1994) Science. 265:781–784.
Orita et al. (1989) Proc. Natl. Acad. Sci. U.S.A. 86: 2776–2770.
Ott J. (1991) Analysis of Human Genetic Linkage. John Hopkins University Press, Baltimore.
Pastinen et al., Genome Research 1997; 7:606–614
Pearson and Lipman, 1988, Proc. Natl. Acad. Sci. USA 85(8):2444–2448;
Pease S. and William R. S. (1990) Exp. Cell. Res. 190:09–211.
Perlin et al. (1994) Am. J. Hum. Genet. 55:777–787.
Peterson et al. (1993) Proc. Natl. Acad. Sci. USA. 90: 7593–7597.
Pietu et al. (1996) Genome Research. 6:492–503.
Potter et al. (1984) Proc. Natl. Acad. Sci. U.S.A. 81(22): 7161–7165.
Rayl et al., (1996) J. Bio. Chem, 271, 2225–2233.
Reid L. H. et al. (1990) Proc. Natl. Acad. Sci. U.S.A. 87:4299–4303.
Risch, N. and Merikangas, K. (1996) Science. 273:1516–1517.
Robertson E. (1987) "Embryo-Derived Stem Cell Lines." In: E. J. Robertson Ed. Teratocarcinomas And Embrionic Stem Cells: A Practical Approach. IRL Press, Oxford, pp. 71.
Rossi et al. (1991) Pharmacol. Ther. 50:245–254.
Roth J. A. et al. (1996) Nature Medicine. 2(9):985–991.
Roux et al. (1989) Proc. Natl. Acad. Sci. U.S.A. 86:9079–9083.
Ruano et al. (1990) Proc. Natl. Acad. Sci. U.S.A. 87:6296–6300.
Sambrook, J., Fritsch, E. F., and T. Maniatis. (1989) Molecular Cloning: A Laboratory Manual. 2ed. Cold Spring Harbor Laboratory, Cold Spring Harbor, N.Y.
Samson M, et al. (1996) Nature, 382(6593):722–725.
Samulski et al. (1989) J. Virol. 63:3822–3828.
Sanchez-Pescador R. (1988) J. Clin. Microbiol. 26(10): 1934–1938.

Sarkar, G. and Sommer S. S. (1991) Biotechniques.
Sauer B. et al. (1988) Proc. Natl. Acad. Sci. U.S.A. 85:5166–5170.
Schaid D. J. et al. (1996) Genet. Epidemiol. 13:423–450.
Schedl A. et al. (1993a) Nature. 362:258–261.
Schedl et al. (1993b) Nucleic Acids Res. 21:4783–4787.
Schedl et al. (1993b) Nucleic Acids Res. 21:4783–4787.
Schena et al. (1995) Science. 270:467–470.
Schena et al. (1996) Proc. Natl. Acad. Sci. U.S.A. 93(20): 10614–10619.
Schneider et al. (1997) Arlequin: A Software For Population Genetics Data Analysis. University of Geneva.
Schwartz and Dayhoff, eds., 1978, Matrices for Detecting Distance Relationships: Atlas of Protein Sequence and Structure, Washington: National Biomedical Research Foundation
Sczakiel G. et al. (1995) Trends Microbiol. 3(6):213–217.
Shay J. W. et al. (1991) Biochem. Biophys. Acta. 1072:1–7.
Sheffield, V. C. et al. (1991) Proc. Natl. Acad. Sci. U.S.A. 49:699–706.
Shizuya et al. (1992) Proc. Natl. Acad. Sci. U.S.A. 89:8794–8797.
Shoemaker D D, Lashkari D A, Morris D, Mittmann M, Davis R W, Nat Genet 1996;14(4):450–456
Smith (1957) Ann. Hum. Genet. 21:254–276.
Smith et al. (1983) Mol. Cell. Biol. 3:2156–2165.
Sosnowski R. G. et al. (1997) Proc. Natl. Acad. Sci. U.S.A. 94:1119–1123.
Spielmann S. and Ewens W. J. (1998) Am. J. Hum. Genet. 62:450–458.
Spielmann S. et al. (1993) Am. J. Hum. Genet. 52:506–516.
Sternberg N. L. (1992) Trends Genet. 8:1–16.
Sternberg N. L. (1994) Mamm. Genome. 5:397–404.
Syvanen A C, Clin Chim Acta 1994;226(2):225–236
Tacson et al. (1996) Nature Medicine. 2(8):888–892.
Te Riele et al. (1990) Nature. 348:649–651.
Terwilliger J. D. and Ott J. (1994) Handbook of Human Genetic Linkage. John Hopkins University Press, London.
Thomas K. R. et al. (1986) Cell. 44:419–428.
Thomas K. R. et al. (1987) Cell. 51:503–512.
Thompson et al., 1994, Nucleic Acids Res. 22(2): 4673–4680;
Tur-Kaspa et al. (1986) Mol. Cell. Biol. 6:716–718.
Tyagi et al. (1998) Nature Biotechnology. 16:49–53.
Urdea M. S. (1988) Nucleic Acids Research. 11:4937–4957.
Urdea M. S. et al. (1991) Nucleic Acids Symp. Ser. 24:197–200.
Van derLugt et al. (1991) Gene. 105:263–267.
Vlasak R. et al. (1983) Eur. J. Biochem. 135:123–126.
Wabiko et al. (1986) DNA. 5(4):305–314.
Walker et al. (1996) Clin. Chem. 42:9–13.
Weir, B. S. (1996) Genetic data Analysis II: Methods for Discretepopulation genetic Data, Sinauer Assoc., Inc., Sunderland, Mass., U.S.A.
White, M. B. et al. (1992) Genomics. 12:301–306.
White, M. B. et al. (1997) Genomics. 12:301–306.
Wong et al. (1980) Gene. 10:87–94.
Wood S. A. et al. (1993) Proc. Natl. Acad. Sci. U.S.A. 90:4582–4585.
Wu and Wu (1987) J. Biol. Chem. 262:4429–4432.
Wu and Wu (1988) Biochemistry. 27:887–892.
Wu et al. (1989) Proc. Natl. Acad. Sci. U.S.A. 86:2757.
Yagi T. et al. (1990) Proc. Natl. Acad. Sci. U.S.A. 87:9918–9922.
Zhao et al. (1998) Am. J. Hum. Genet. 63:225–240.
Zou Y. R. et al. (1994) Curr. Biol. 4:1099–1103

SEQUENCE LISTING (234 sequences)

SEQ ID NO: 1 - DNA, 319608 bp, Homo sapiens
  misc_feature 31..1107: 5'regulatory region g35018 gene
  exon 1108..1289: exon A g35018 gene
  exon 14877..14920: exon B g35018 gene
  exon 18778..18862: exon Bbis g35018 gene
  exon 25593..25740: exon C g35018 gene
  exon 29388..29502: exon D g35018 gene
  exon 29967..30282: exon E g35018 gene
  exon 64666..64812: exon F g35018 gene
  exon 65505..65853: exon G g35018 gene
  misc_feature 65854..67854: 3'regulatory region g35018 gene
  exon 94124..94964: exon g35017
  exon 201188..201234: exon S g35030 gene
  exon 214676..214793: exon T g35030 gene
  exon 215702..215746: exon U g35030 gene
  exon 216836..216915: exon V g35030 gene
  misc_feature 213818..215818: 3'regulatory region g34872 gene
  exon 215819..215941: exon R complement g34872 gene
  exon 215819..215975: exon Rbis complement g34872 gene
  exon 216661..216952: exon Qbis complement g34872 gene
  exon 216661..217061: exon Q complement g34872 gene
  exon 217027..217061: exon Q1 complement g34872 gene
  exon 229647..229742: exon X complement g34872 gene
  exon 230408..230721: exon P complement g34872 gene
  exon 231272..231412: exon Obis complement g34872 gene
  exon 231787..231880: exon O2 complement g34872 gene
  exon 231870..231879: exon O1 complement g34872 gene
  exon 234174..234321: exon O complement g34872 gene
  exon 237406..237428: exon Nbis complement g34872 gene
  exon 239719..239807: exon N2 complement g34872 gene
  exon 239719..239853: exon N complement g34872 gene
  exon 240528..240569: exon M1117 complement g34872 gene
  exon 240528..240596: exon M1090 complement g34872 gene
  exon 240528..240617: exon M1069 complement g34872 gene
  exon 240528..240644: exon MS2 complement g34872 gene
  exon 240528..240824: exon M862 complement g34872 gene
  exon 240528..240994: exon M692 complement g34872 gene
  exon 240528..241685: exon M1 complement g34872 gene
  exon 240800..240993: exon MS1 complement g34872 gene
  misc_feature 241686..243685: 5'regulatory region g34872 gene
  misc_feature 290652..292652: 3'regulatory region g34665 gene
  exon 292653..292841: exon B complement g34665 gene
  exon 295555..296047: exon Ab complement g34665 gene
  exon 295980..296047: exon A complement g34665 gene
  misc_feature 296048..298048: 5'regulatory region g34665 gene
  allele 8316: 99-27943-150  : polymorphic base G or C
  allele 14726: 8-121-28  : polymorphic base A or T
  allele 14734: 8-121-36  : polymorphic base C or T
  allele 14852: 8-121-154  : polymorphic base A or T
  allele 14885: 8-121-187  : polymorphic base A or C
  allele 14941: 8-121-243  : polymorphic base G or T
  allele 14979: 8-121-281  : polymorphic base A or C
  allele 15050: 8-121-352  : polymorphic base C or T
  allele 15062: 8-121-364  : polymorphic base C or T
  allele 15069: 8-121-371  : polymorphic base A or G
  allele 21672: 99-27935-193  : polymorphic base G or C
  allele 25480: 8-122-72  : polymorphic base A or T
  allele 25508: 8-122-100  : polymorphic base C or T
  allele 25679: 8-122-271  : deletion of CAAA
  allele 25680: 8-122-272  : polymorphic base A or G
  allele 25734: 8-122-326  : polymorphic base A or C
  allele 25768: 8-122-360  : polymorphic base C or T
  allele 29403: 8-123-55  : polymorphic base A or T
  allele 29537: 8-123-189  : polymorphic base C or T
  allele 29545: 8-123-197  : polymorphic base C or T
  allele 29655: 8-123-307  : polymorphic base G or C
  allele 30169: 8-147-270  : polymorphic base A or G
  allele 49475: 99-34243-210  : polymorphic base A or T
  allele 64666: 8-127-28  : polymorphic base A or G
  allele 64757: 8-127-119  : polymorphic base A or G
  allele 64797: 8-127-159  : polymorphic base A or C
  allele 64874: 8-127-236  : polymorphic base C or T
  allele 64878: 8-127-240  : polymorphic base A or G
  allele 64918: 8-127-280  : polymorphic base G or T
  allele 65485: 8-128-33  : polymorphic base C or T
  allele 65504: 8-128-52  : polymorphic base A or G
  allele 65513: 8-128-61  : polymorphic base G or C
  allele 65520: 8-128-68  : polymorphic base C or T
  allele 65521: 8-128-69  : polymorphic base A or G
  allele 65537: 8-128-85  : polymorphic base A or C
  allele 65596: 8-129-50  : polymorphic base C or T
  allele 65607: 8-129-60  : deletion of A
  allele 65857: 8-129-311  : polymorphic base A or G
  allele 65947: 8-129-401  : polymorphic base C or T
  allele 75667: 99-34240-492  : polymorphic base A or T
  allele 94534: 99-31959-281  : polymorphic base C or T
  allele 95396: 99-31960-363  : polymorphic base A or G
  allele 96956: 99-31962-250  : polymorphic base C or T
  allele 97156: 99-31962-450  : polymorphic base A or G
  allele 106384: 99-44282-439  : polymorphic base A or G
  allele 106769: 99-44282-54  : polymorphic base C or T
  allele 107158: 99-24656-137  : polymorphic base A or G
  allele 107281: 99-24656-260  : polymorphic base A or G
  allele 107609: 99-24636-22  : polymorphic base A or G
  allele 108499: 99-31939-75  : polymorphic base A or G
  allele 108697: 99-31939-273  : polymorphic base C or T
  allele 109451: 99-44281-418  : polymorphic base G or T
  allele 109612: 99-44281-257  : polymorphic base A or G
  allele 109792: 99-44281-77  : polymorphic base A or G
  allele 112468: 99-31941-320  : polymorphic base G or T
  allele 115468: 99-31942-325  : polymorphic base G or T
  allele 155736: 99-24635-79  : polymorphic base A or T
  allele 158172: 99-16059-313  : polymorphic base A or G
  allele 160634: 99-24639-169  : polymorphic base C or T
  allele 160640: 99-24639-163  : polymorphic base A or C
  allele 160876: 99-24634-108  : polymorphic base A or T
  allele 168974: 99-7652-162  : polymorphic base A or G
  allele 169300: 99-7652-488  : polymorphic base A or G
  allele 170746: 99-16100-83  : polymorphic base C or T
  allele 170810: 99-16100-147  : polymorphic base A or G
  allele 170858: 99-16100-195  : polymorphic base G or T
  allele 170860: 99-16100-197  : polymorphic base C or T
  allele 170906: 99-16100-244  : polymorphic base C or T
  allele 171043: 99-16100-381  : polymorphic base A or C
  allele 173358: 99-5862-167  : polymorphic base A or G
  allele 174227: 99-16083-101  : polymorphic base C or T
  allele 175800: 99-16044-351  : polymorphic base C or T
  allele 180589: 99-16042-420  : polymorphic base A or G
  allele 180978: 99-16042-31  : polymorphic base G or C
  allele 189957: 99-5919-215  : polymorphic base A or G
  allele 197163: 99-24658-410  : polymorphic base A or G
  allele 198964: 99-30364-299  : polymorphic base A or G
  allele 200256: 99-30366-112  : polymorphic base G or T
  allele 204588: 99-16094-75  : polymorphic base G or T
  allele 204934: 99-24644-194  : polymorphic base A or G
  allele 206197: 99-16107-95  : polymorphic base A or T
  allele 206263: 99-16107-161  : polymorphic base A or G
  allele 206485: 99-16107-383  : polymorphic base C or T
  allele 211608: 99-15873-303  : polymorphic base C or T
  allele 214669: 8-124-106  : polymorphic base A or G
  allele 214783: 8-124-220  : polymorphic base A or G
  allele 214857: 8-124-294  : polymorphic base A or G
  allele 214879: 8-124-316  : polymorphic base C or T
  allele 214946: 8-124-383  : polymorphic base A or T
  allele 215538: 8-125-33  : polymorphic base C or T
  allele 215705: 8-132-312  : polymorphic base A or G
  allele 215838: 8-132-179  : polymorphic base A or T
  allele 215853: 8-132-164  : polymorphic base A or G
  allele 215920: 8-132-97  : polymorphic base A or G
  allele 216028: 99-13929-201  : polymorphic base G or T
  allele 216538: 8-131-363  : polymorphic base G or T
  allele 216702: 8-131-199  : polymorphic base G or T
  allele 216874: 8-130-236  : polymorphic base C or T
  allele 216890: 8-130-220  : polymorphic base G or T
  allele 216966: 8-130-144  : polymorphic base C or T
  allele 216967: 8-130-143  : polymorphic base A or G
  allele 217008: 8-130-102  : polymorphic base C or T
  allele 217009: 8-130-101  : polymorphic base G or T
  allele 217027: 8-130-83  : polymorphic base A or C
  allele 217207: 8-209-333  : polymorphic base A or G
  allele 217250: 8-209-290  : polymorphic base A or C
  allele 219540: 99-5897-143  : polymorphic base A or C
  allele 220836: 99-24649-186  : polymorphic base A or G
  allele 220942: 99-24649-80  : polymorphic base G or C
  allele 221741: 8-199-84  : polymorphic base G or T
  allele 222048: 8-198-138  : polymorphic base A or G
  allele 222746: 8-195-348  : polymorphic base C or T
  allele 223595: 99-13925-97  : polymorphic base A or G
  allele 225443: 8-192-82  : polymorphic base A or G
  allele 226219: 99-16090-225  : polymorphic base A or G
  allele 226282: 8-189-340  : deletion of CTAT
  allele 226487: 8-189-146  : polymorphic base G or T
  allele 226870: 8-188-136  : polymorphic base C or T
  allele 226987: 8-187-352  : polymorphic base G or T
  allele 227589: 8-185-319  : polymorphic base G or T
  allele 227612: 8-185-296  : polymorphic base A or T
  allele 228006: 99-16051-226  : polymorphic base C or T
  allele 228068: 99-16051-164  : polymorphic base A or G
  allele 228134: 8-184-119  : polymorphic base A or T
  allele 228226: 8-184-27  : polymorphic base A or C
  allele 228254: 8-183-401  : polymorphic base C or T
  allele 229069: 8-181-449  : polymorphic base C or T
  allele 229168: 8-181-350  : polymorphic base A or T
  allele 229259: 8-181-259  : polymorphic base A or G
  allele 229288: 8-181-230  : polymorphic base A or T
  allele 229308: 8-181-210  : polymorphic base A or T
  allele 229353: 8-181-165  : polymorphic base C or T
  allele 229355: 8-181-163  : polymorphic base C or T
  allele 229435: 8-181-83  : polymorphic base C or T
  allele 229486: 8-180-157  : polymorphic base A or T
  allele 229582: 8-143-332  : polymorphic base A or C
  allele 229587: 8-143-327  : polymorphic base A or G
  allele 229603: 8-143-311  : polymorphic base A or G
  allele 229606: 8-143-308  : polymorphic base A or G
  allele 229607: 8-179-268  : polymorphic base A or C
  allele 229608: 8-143-306  : polymorphic base A or G
  allele 229669: 8-143-245  : polymorphic base G or T
  allele 229672: 8-143-242  : polymorphic base A or G
  allele 229675: 8-143-239  : polymorphic base C or T
  allele 229682: 8-143-232  : polymorphic base G or C
  allele 229762: 8-143-152  : polymorphic base G or C
  allele 229961: 8-178-199  : polymorphic base G or C
  allele 230037: 8-178-123  : deletion of A
  allele 230238: 8-119-404  : polymorphic base C or T
  allele 230256: 8-177-281  : polymorphic base C or T
  allele 230265: 8-119-377  : polymorphic base C or T
  allele 230333: 8-119-309  : polymorphic base C or T
  allele 230348: 8-119-294  : polymorphic base G or T
  allele 230358: 8-119-284  : polymorphic base G or C
  allele 230370: 8-119-272  : polymorphic base A or T
  allele 230380: 8-119-262  : polymorphic base A or T
  allele 230394: 8-119-248  : polymorphic base C or T
  allele 230395: 8-119-247  : polymorphic base A or G
  allele 230432: 8-119-210  : polymorphic base A or C
  allele 230438: 8-119-204  : polymorphic base A or C
  allele 230442: 8-119-200  : polymorphic base A or G
  allele 230447: 8-119-195  : polymorphic base A or C
  allele 230517: 8-119-125  : polymorphic base C or T
  allele 230522: 8-119-120  : polymorphic base A or G
  allele 230545: 8-119-97  : polymorphic base C or T
  allele 230549: 8-119-93  : polymorphic base G or T
  allele 230604: 8-119-38  : polymorphic base A or T
  allele 230684: 8-138-234  : polymorphic base C or T
  allele 230700: 8-138-218  : polymorphic base A or G
  allele 230755: 8-138-163  : polymorphic base C or T
  allele 230864: 8-138-54  : insertion of TA
  allele 231070: 8-175-75  : polymorphic base G or T
  allele 231118: 8-142-386  : polymorphic base C or T
  allele 231134: 8-142-370  : polymorphic base C or T
  allele 231290: 8-142-211  : deletion of CAAA
  allele 231372: 8-142-132  : polymorphic base A or G
  allele 231669: 8-145-339  : polymorphic base C or T
  allele 231677: 99-15870-400  : polymorphic base A or G
  allele 231777: 8-145-231  : polymorphic base A or T
  allele 231811: 8-145-197  : polymorphic base C or T
  allele 231854: 8-145-154  : polymorphic base C or T
  allele 231870: 8-145-138  : polymorphic base A or C
  allele 231930: 8-145-78  : polymorphic base G or C
  allele 232320: 8-171-247  : polymorphic base C or T
  allele 232477: 8-170-373  : polymorphic base C or T
  allele 232898: 8-169-266  : polymorphic base A or G
  allele 232998: 8-169-166  : polymorphic base G or T
  allele 233100: 8-168-380  : polymorphic base A or G
  allele 233453: 8-235-349  : polymorphic base C or T
  allele 233620: 8-235-182  : polymorphic base G or T
  allele 234120: 8-137-340  : polymorphic base G or C
  allele 234277: 8-137-182  : polymorphic base C or T
  allele 234307: 8-137-152  : polymorphic base A or C
  allele 234751: 8-165-185  : polymorphic base G or C
  allele 235315: 99-16087-219  : polymorphic base G or C
  allele 238223: 8-157-177  : polymorphic base A or C
  allele 238789: 8-155-258  : polymorphic base C or T
  allele 239763: 99-16038-118  : polymorphic base C or T
  allele 239864: 8-136-166  : polymorphic base A or G
  allele 239885: 8-136-145  : polymorphic base A or G
  allele 239950: 8-136-80  : polymorphic base C or T
  allele 240044: 8-153-32  : polymorphic base A or G
  allele 240497: 8-135-212  : polymorphic base A or G
  allele 240543: 8-135-166  : polymorphic base G or T
  allele 240597: 8-135-112  : polymorphic base A or G
  allele 240772: 99-16050-235  : polymorphic base G or C
  allele 240858: 8-144-378  : polymorphic base C or T
  allele 241002: 8-144-234  : polymorphic base C or T
  allele 241040: 8-144-196  : polymorphic base A or T
  allele 241002: 8-144-127  : deletion of TGGATAC
  allele 241217: 8-141-304  : polymorphic base C or T
  allele 241261: 8-141-260  : polymorphic base C or T
  allele 241360: 8-141-161  : polymorphic base G or T
  allele 241507: 8-140-286  : polymorphic base A or G
  allele 241620: 8-140-173  : polymorphic base A or C
  allele 241685: 8-140-108  : polymorphic base G or C
  allele 241752: 8-140-41  : polymorphic base A or G
  allele 241861: 99-15880-162  : polymorphic base A or G
  allele 242402: 8-240-187  : polymorphic base G or T
  allele 244313: 8-225-281  : polymorphic base A or T
  allele 247860: 99-25940-186  : polymorphic base A or G
  allele 247864: 99-25940-182  : polymorphic base C or T
  allele 248315: 99-16032-292  : polymorphic base G or T
  allele 253619: 99-16055-216  : polymorphic base A or G
  allele 255848: 99-16105-152  : polymorphic base A or G
  allele 258573: 99-16101-436  : polymorphic base C or T
  allele 260099: 99-16033-244  : polymorphic base A or G
  allele 279789: 99-15875-165  : polymorphic base C or T
  allele 288007: 99-13521-31  : polymorphic base A or G
  allele 292680: 8-112-241  : polymorphic base C or T
  allele 292766: 8-112-155  : polymorphic base A or C
  allele 292876: 8-112-45  : polymorphic base A or T
  allele 295491: 8-111-301  : deletion of AGAT
  allele 295716: 8-110-404  : polymorphic base G or C
  allele 296031: 8-110-89  : polymorphic base A or G
  allele 296068: 8-134-94  : polymorphic base C or T
  allele 298969: 99-7462-508  : polymorphic base C or T
  allele 300365: 99-16052-214  : polymorphic base A or G
  allele 312030: 99-16047-115  : polymorphic base A or G
  allele 315928: 99-25993-280  : polymorphic base G or C
  allele 316014: 99-25993-367  : polymorphic base A or G
  allele 317245: 99-25101-151  : polymorphic base A or G
  primer_bind 7938..7958: 99-27943.rp
  primer_bind 8446..8465: 99-27943.pu complement
  primer_bind 14699..14718: 8-121.pu
  primer_bind 15100..15118: 8-121.rp  complement
  primer_bind 21365..21385: 99-27935.rp
  primer_bind 21845..21864: 99-27935.pu complement
  primer_bind 25409..25426: 8-122.pu
  primer_bind 25825..25844: 8-122.rp  complement
  primer_bind 29349..29366: 8-123.pu
  primer_bind 29684..29701: 8-123.rp  complement
  primer_bind 29900..29919: 8-147.pu
  primer_bind 30340..30356: 8-147.rp  complement
  primer_bind 49219..49239: 99-34243.rp
  primer_bind 49664..49684: 99-34243.pu complement
  primer_bind 64639..64657: 8-127.pu
  primer_bind 64981..64999: 8-127.rp  complement
  primer_bind 65453..65471: 8-128.pu
  primer_bind 65547..65566: 8-129.pu
  primer_bind 65856..65874: 8-128.rp  complement
  primer_bind 65949..65966: 8-129.rp  complement
  primer_bind 75629..75649: 99-34240.rp
  primer_bind 76140..76158: 99-34240.pu complement
  primer_bind 94254..94273: 99-31959.pu
  primer_bind 94683..94703: 99-31959.rp  complement
  primer_bind 95034..95053: 99-31960.pu
  primer_bind 95543..95563: 99-31960.rp  complement
  primer_bind 96707..96727: 99-31962.pu
  primer_bind 97222..97242: 99-31962.rp  complement
  primer_bind 106357..106377: 99-44282.rp
  primer_bind 106805..106822: 99-44282.pu complement
  primer_bind 107022..107040: 99-24656.pu
  primer_bind 107132..107152: 99-24636.rp
  primer_bind 107495..107513: 99-24656.rp  complement
  primer_bind 107613..107630: 99-24636.pu complement
  primer_bind 108425..108444: 99-31939.pu
  primer_bind 108916..108935: 99-31939.rp  complement
  primer_bind 109333..109353: 99-44281.rp
  primer_bind 109848..109868: 99-44281.pu complement
  primer_bind 112149..112169: 99-31941.pu
  primer_bind 112720..112740: 99-31941.rp  complement
  primer_bind 115144..115162: 99-31942.pu
  primer_bind 115617..115637: 99-31942.rp  complement
  primer_bind 155353..155373: 99-24635.rp
  primer_bind 155805..155822: 99-24635.pu complement
  primer_bind 157860..157878: 99-16059.pu
  primer_bind 158296..158316: 99-16059.rp  complement
  primer_bind 160279..160298: 99-24639.rp
  primer_bind 160770..160787: 99-24634.pu
  primer_bind 160785..160802: 99-24639.pu complement
  primer_bind 161240..161257: 99-24634.rp  complement
  primer_bind 168813..168830: 99-7652.pu
  primer_bind 169331..169351: 99-7652.rp  complement
  primer_bind 170666..170686: 99-16100.pu
  primer_bind 171153..171173: 99-16100.rp  complement
  primer_bind 173065..173085: 99-5862.rp
  primer_bind 173495..173514: 99-5862.pu complement
  primer_bind 173830..173850: 99-16083.rp
  primer_bind 174309..174327: 99-16083.pu complement
  primer_bind 175453..175470: 99-16044.pu
  primer_bind 175881..175901: 99-16044.rp  complement
  primer_bind 180464..180481: 99-16042.rp
  primer_bind 180991..181008: 99-16042.pu complement
  primer_bind 189753..189771: 99-5919.pu
  primer_bind 190187..190207: 99-5919.rp  complement
  primer_bind 197116..197135: 99-24658.rp
  primer_bind 197555..197572: 99-24658.pu complement
  primer_bind 198666..198684: 99-30364.pu
  primer_bind 199148..199168: 99-30364.rp  complement
  primer_bind 200145..200162: 99-30366.pu
  primer_bind 200663..200683: 99-30366.rp  complement
  primer_bind 204263..204282: 99-16094.rp
  primer_bind 204643..204662: 99-16094.pu complement
  primer_bind 204741..204758: 99-24644.pu
  primer_bind 205222..205240: 99-24644.rp  complement
  primer_bind 206103..206120: 99-16107.pu
  primer_bind 206548..206568: 99-16107.rp  complement
  primer_bind 211454..211471: 99-15873.rp
  primer_bind 211893..211910: 99-15873.pu complement
  primer_bind 214564..214581: 8-124.pu
  primer_bind 214965..214983: 8-124.rp  complement
  primer_bind 215506..215525: 8-125.pu
  primer_bind 215628..215647: 8-132.rp
  primer_bind 215749..215769: 99-13929.rp
  primer_bind 215924..215942: 8-125.rp  complement
  primer_bind 215998..216016: 8-132.pu complement
  primer_bind 216210..216228: 99-13929.pu complement
  primer_bind 216473..216491: 8-131.rp
  primer_bind 216683..216702: 8-130.rp
  primer_bind 216883..216900: 8-131.pu complement
  primer_bind 217091..217109: 8-130.pu complement
  primer_bind 217119..217136: 8-209.rp
  primer_bind 217521..217539: 8-209.pu complement
  primer_bind 219408..219425: 99-5897.pu
  primer_bind 219882..219899: 99-5897.rp  complement
  primer_bind 220505..220522: 99-24649.rp
  primer_bind 221004..221021: 99-24649.pu complement
  primer_bind 221384..221402: 8-199.rp
  primer_bind 221740..221759: 8-198.rp
  primer_bind 221807..221824: 8-199.pu complement
  primer_bind 222167..222185: 8-198.pu complement
  primer_bind 222696..222713: 8-195.rp
  primer_bind 223073..223093: 8-195.pu complement
  primer_bind 223499..223518: 99-13925.pu
  primer_bind 224013..224033: 99-13925.rp  complement
  primer_bind 225103..225120: 8-192.rp
  primer_bind 225505..225524: 8-192.pu complement
  primer_bind 225995..226013: 99-16090.pu
  primer_bind 226211..226230: 8-189.rp
  primer_bind 226510..226530: 99-16090.rp  complement
  primer_bind 226569..226588: 8-188.rp
  primer_bind 226615..226632: 8-189.pu complement
  primer_bind 226915..226934: 8-187.rp
  primer_bind 226988..227005: 8-188.pu complement
  primer_bind 227319..227338: 8-187.pu complement
  primer_bind 227468..227487: 8-185.rp
  primer_bind 227768..227788: 99-16051.rp
  primer_bind 227832..227849: 8-184.rp
  primer_bind 227888..227907: 8-185.pu complement
  primer_bind 228209..228227: 8-183.rp
  primer_bind 228214..228231: 99-16051.pu complement
  primer_bind 228234..228252: 8-184.pu complement
  primer_bind 228635..228654: 8-183.pu complement
  primer_bind 228898..228917: 8-181.rp
  primer_bind 229442..229459: 8-179.rp
  primer_bind 229443..229462: 8-180.rp
  primer_bind 229487..229506: 8-143.rp
  primer_bind 229499..229517: 8-181.pu complement
  primer_bind 229624..229642: 8-180.pu complement
  primer_bind 229739..229756: 8-178.rp
  primer_bind 229857..229874: 8-179.pu complement
  primer_bind 229896..229913: 8-143.pu complement
  primer_bind 230097..230115: 8-177.rp
  primer_bind 230141..230159: 8-178.pu complement
  primer_bind 230210..230227: 8-119.rp
  primer_bind 230517..230536: 8-138.rp
  primer_bind 230517..230536: 8-177.pu complement
  primer_bind 230622..230641: 8-119.pu complement
  primer_bind 230705..230724: 8-175.rp
  primer_bind 230899..230917: 8-138.pu complement
  primer_bind 231084..231103: 8-142.rp
  primer_bind 231127..231144: 8-175.pu complement
  primer_bind 231278..231298: 99-15870.pu
  primer_bind 231485..231503: 8-142.pu complement
  primer_bind 231588..231605: 8-145.rp
  primer_bind 231729..231747: 99-15870.rp  complement
  primer_bind 231990..232007: 8-145.pu complement
  primer_bind 232147..232166: 8-171.rp
  primer_bind 232405..232423: 8-170.rp
  primer_bind 232547..232566: 8-171.pu complement
  primer_bind 232744..232762: 8-169.rp
  primer_bind 232830..232849: 8-170.pu complement
  primer_bind 233056..233074: 8-168.rp
  primer_bind 233145..233163: 8-169.pu complement
  primer_bind 233314..233334: 8-235.rp
  primer_bind 233461..233479: 8-168.pu complement
  primer_bind 233785..233801: 8-235.pu complement
  primer_bind 234039..234058: 8-137.rp
  primer_bind 234440..234458: 8-137.pu complement
  primer_bind 234516..234533: 8-165.rp
  primer_bind 234916..234935: 8-165.pu complement
  primer_bind 235081..235101: 99-16087.rp
  primer_bind 235515..235533: 99-16087.pu complement
  primer_bind 237972..237989: 8-157.rp
  primer_bind 238381..238399: 8-157.pu complement
  primer_bind 238607..238626: 8-155.rp
  primer_bind 239029..239046: 8-155.pu complement
  primer_bind 239405..239425: 99-16038.rp
  primer_bind 239606..239624: 8-136.rp
  primer_bind 239651..239670: 8-153.rp
  primer_bind 239862..239880: 99-16038.pu complement
  primer_bind 240012..240029: 8-136.pu complement
  primer_bind 240058..240075: 8-153.pu complement
  primer_bind 240356..240375: 8-135.rp
  primer_bind 240518..240538: 99-16050.rp
  primer_bind 240691..240708: 8-135.pu complement
  primer_bind 240810..240828: 8-144.rp
  primer_bind 240988..241006: 99-16050.pu complement
  primer_bind 241094..241113: 8-141.rp
  primer_bind 241217..241235: 8-144.pu complement
  primer_bind 241373..241392: 8-140.rp
  primer_bind 241502..241520: 8-141.pu complement
  primer_bind 241700..241717: 99-15880.pu
  primer_bind 241773..241792: 8-140.pu complement
  primer_bind 242151..242171: 99-15880.rp  complement
  primer_bind 242169..242188: 8-240.rp
  primer_bind 242571..242588: 8-240.pu complement
  primer_bind 244172..244191: 8-225.rp
  primer_bind 244574..244593: 8-225.pu complement
  primer_bind 247513..247533: 99-25940.rp
  primer_bind 248023..248043: 99-25940.pu complement
  primer_bind 248204..248223: 99-16032.rp
  primer_bind 248588..248606: 99-16032.pu complement
  primer_bind 253315..253333: 99-16055.rp
  primer_bind 253816..253834: 99-16055.pu complement
  primer_bind 255697..255715: 99-16105.pu
  primer_bind 256133..256152: 99-16105.rp  complement
  primer_bind 258138..258155: 99-16101.pu
  primer_bind 258606..258623: 99-16101.rp  complement
  primer_bind 259885..259902: 99-16033.rp
  primer_bind 260324..260342: 99-16033.pu complement
  primer_bind 279626..279644: 99-15875.pu
  primer_bind 280154..280173: 99-15875.rp  complement
  primer_bind 287977..287995: 99-13521.pu
  primer_bind 288484..288504: 99-13521.rp  complement
  primer_bind 292501..292519: 8-112.rp
  primer_bind 292901..292920: 8-112.pu complement
  primer_bind 295376..295395: 8-111.rp
  primer_bind 295682..295701: 8-110.rp
  primer_bind 295777..295795: 8-111.pu complement
  primer_bind 295812..295830: 8-134.rp
  primer_bind 296102..296119: 8-110.pu complement
  primer_bind 296143..296161: 8-134.pu complement
  primer_bind 298946..298964: 99-7462.rp
  primer_bind 299459..299476: 99-7462.pu complement
  primer_bind 300153..300170: 99-16052.pu
  primer_bind 300660..300680: 99-16052.rp  complement
  primer_bind 311615..311632: 99-16047.rp
  primer_bind 312126..312144: 99-16047.pu complement
  primer_bind 315649..315668: 99-25993.pu
  primer_bind 316129..316147: 99-25993.rp  complement
  primer_bind 316925..316943: 99-25101.rp
  primer_bind 317378..317395: 99-25101.pu complement
  primer_bind 8297..8315: 99-27943-150.mis
  primer_bind 8317..8335: 99-27943-150.mis complement
  primer_bind 14707..14725: 8-121-28.mis
  primer_bind 14715..14733: 8-121-36.mis
  primer_bind 14727..14745: 8-121-28.mis complement
  primer_bind 14735..14753: 8-121-36.mis complement
  primer_bind 14833..14851: 8-121-154.mis
  primer_bind 14853..14871: 8-121-154.mis complement
  primer_bind 14866..14884: 8-121-187.mis
  primer_bind 14886..14904: 8-121-187.mis complement
  primer_bind 14922..14940: 8-121-243.mis
  primer_bind 14942..14960: 8-121-243.mis complement
  primer_bind 14960..14978: 8-121-281.mis
  primer_bind 14980..14998: 8-121-281.mis complement
  primer_bind 15031..15049: 8-121-352.mis
  primer_bind 15043..15061: 8-121-364.mis
  primer_bind 15050..15068: 8-121-371.mis
  primer_bind 15051..15069: 8-121-352.mis complement
  primer_bind 15063..15081: 8-121-364.mis complement
  primer_bind 15070..15088: 8-121-371.mis complement
  primer_bind 21653..21671: 99-27935-193.mis
  primer_bind 21673..21691: 99-27935-193.mis complement
  primer_bind 25461..25479: 8-122-72.mis
  primer_bind 25481..25499: 8-122-72.mis complement
  primer_bind 25489..25507: 8-122-100.mis
  primer_bind 25509..25527: 8-122-100.mis complement
  primer_bind 25661..25679: 8-122-272.mis
  primer_bind 25681..25699: 8-122-272.mis complement
  primer_bind 25715..25733: 8-122-326.mis
  primer_bind 25735..25753: 8-122-326.mis complement
  primer_bind 25749..25767: 8-122-360.mis
  primer_bind 25769..25787: 8-122-360.mis complement
  primer_bind 29384..29402: 8-123-55.mis
  primer_bind 29404..29422: 8-123-55.mis complement
  primer_bind 29518..29536: 8-123-189.mis
  primer_bind 29526..29544: 8-123-197.mis
  primer_bind 29538..29556: 8-123-189.mis complement
  primer_bind 29546..29564: 8-123-197.mis complement
  primer_bind 29636..29654: 8-123-307.mis
  primer_bind 29656..29674: 8-123-307.mis complement
  primer_bind 30150..30168: 8-147-270.mis
  primer_bind 30170..30188: 8-147-270.mis complement
  primer_bind 49456..49474: 99-34243-210.mis
  primer_bind 49476..49494: 99-34243-210.mis complement
  primer_bind 64647..64665: 8-127-28.mis
  primer_bind 64667..64685: 8-127-28.mis complement
  primer_bind 64738..64756: 8-127-119.mis
  primer_bind 64758..64776: 8-127-119.mis complement
  primer_bind 64778..64796: 8-127-159.mis
  primer_bind 64798..64816: 8-127-159.mis complement
  primer_bind 64855..64873: 8-127-236.mis
  primer_bind 64859..64877: 8-127-240.mis
  primer_bind 64875..64893: 8-127-236.mis complement
  primer_bind 64879..64897: 8-127-240.mis complement
  primer_bind 64899..64917: 8-127-280.mis
  primer_bind 64919..64937: 8-127-280.mis complement
  primer_bind 65466..65484: 8-128-33.mis
  primer_bind 65485..65503: 8-128-52.mis
  primer_bind 65486..65504: 8-128-33.mis complement
  primer_bind 65494..65512: 8-128-61.mis
  primer_bind 65501..65519: 8-128-68.mis
  primer_bind 65502..65520: 8-128-69.mis
  primer_bind 65505..65523: 8-128-52.mis complement
  primer_bind 65514..65532: 8-128-61.mis complement
  primer_bind 65518..65536: 8-128-85.mis
  primer_bind 65521..65539: 8-128-68.mis complement
  primer_bind 65522..65540: 8-128-69.mis complement
  primer_bind 65538..65556: 8-128-85.mis complement
  primer_bind 65577..65595: 8-129-50.mis
  primer_bind 65597..65615: 8-129-50.mis complement
  primer_bind 65838..65856: 8-129-311.mis
  primer_bind 65858..65876: 8-129-311.mis complement
  primer_bind 65928..65946: 8-129-401.mis
  primer_bind 65948..65966: 8-129-401.mis complement
  primer_bind 75648..75666: 99-34240-492.mis
  primer_bind 75668..75686: 99-34240-492.mis complement
  primer_bind 94515..94533: 99-31959-281.mis
  primer_bind 94535..94553: 99-31959-281.mis complement
  primer_bind 95377..95395: 99-31960-363.mis
  primer_bind 95397..95415: 99-31960-363.mis complement
  primer_bind 96937..96955: 99-31962-250.mis
  primer_bind 96957..96975: 99-31962-250.mis complement
  primer_bind 97137..97155: 99-31962-450.mis
  primer_bind 97157..97175: 99-31962-450.mis complement
  primer_bind 106365..106383: 99-44282-439.mis
  primer_bind 106385..106403: 99-44282-439.mis complement
  primer_bind 106750..106768: 99-44282-54.mis
  primer_bind 106770..106788: 99-44282-54.mis complement
  primer_bind 107139..107157: 99-24656-137.mis
  primer_bind 107159..107177: 99-24656-137.mis complement
  primer_bind 107262..107280: 99-24656-260.mis
  primer_bind 107282..107300: 99-24656-260.mis complement
  primer_bind 107590..107608: 99-24636-22.mis
  primer_bind 107610..107628: 99-24636-22.mis complement
  primer_bind 108480..108498: 99-31939-75.mis
  primer_bind 108500..108518: 99-31939-75.mis complement
  primer_bind 108678..108696: 99-31939-273.mis
  primer_bind 108698..108716: 99-31939-273.mis complement
  primer_bind 109432..109450: 99-44281-418.mis
  primer_bind 109452..109470: 99-44281-418.mis complement
  primer_bind 109593..109611: 99-44281-257.mis
  primer_bind 109613..109631: 99-44281-257.mis complement
  primer_bind 109773..109791: 99-44281-77.mis
  primer_bind 109793..109811: 99-44281-77.mis complement
  primer_bind 112449..112467: 99-31941-320.mis
  primer_bind 112469..112487: 99-31941-320.mis complement
  primer_bind 115449..115467: 99-31942-325.mis
  primer_bind 115469..115487: 99-31942-325.mis complement
  primer_bind 155717..155735: 99-24635-79.mis
  primer_bind 155737..155755: 99-24635-79.mis complement
  primer_bind 158153..158171: 99-16059-313.mis
  primer_bind 158173..158191: 99-16059-313.mis complement
  primer_bind 160615..160633: 99-24639-169.mis
  primer_bind 160621..160639: 99-24639-163.mis
  primer_bind 160635..160653: 99-24639-169.mis complement
  primer_bind 160641..160659: 99-24639-163.mis complement
  primer_bind 160857..160875: 99-24634-108.mis
  primer_bind 160877..160895: 99-24634-108.mis complement
  primer_bind 168955..168973: 99-7652-162.mis
  primer_bind 168975..168993: 99-7652-162.mis complement
  primer_bind 169281..169299: 99-7652-488.mis
  primer_bind 169301..169319: 99-7652-488.mis complement
  primer_bind 170727..170745: 99-16100-83.mis
  primer_bind 170747..170765: 99-16100-83.mis complement
  primer_bind 170791..170809: 99-16100-147.mis
  primer_bind 170811..170829: 99-16100-147.mis complement
  primer_bind 170839..170857: 99-16100-195.mis
  primer_bind 170841..170859: 99-16100-197.mis
  primer_bind 170859..170877: 99-16100-195.mis complement
  primer_bind 170861..170879: 99-16100-197.mis complement
  primer_bind 170887..170905: 99-16100-244.mis
  primer_bind 170907..170925: 99-16100-244.mis complement
  primer_bind 171024..171042: 99-16100-381.mis
  primer_bind 171044..171062: 99-16100-381.mis complement
  primer_bind 173339..173357: 99-5862-167.mis
  primer_bind 173359..173377: 99-5862-167.mis complement
  primer_bind 174208..174226: 99-16083-101.mis
  primer_bind 174228..174246: 99-16083-101.mis complement
  primer_bind 175781..175799: 99-16044-351.mis
  primer_bind 175801..175819: 99-16044-351.mis complement
  primer_bind 180570..180588: 99-16042-420.mis
  primer_bind 180590..180608: 99-16042-420.mis complement
  primer_bind 180959..180977: 99-16042-31.mis
  primer_bind 180979..180997: 99-16042-31.mis complement
  primer_bind 189938..189956: 99-5919-215.mis
  primer_bind 189958..189976: 99-5919-215.mis complement
  primer_bind 197144..197162: 99-24658-410.mis
  primer_bind 197164..197182: 99-24658-410.mis complement
  primer_bind 198945..198963: 99-30364-299.mis
  primer_bind 198965..198983: 99-30364-299.mis complement
  primer_bind 200237..200255: 99-30366-112.mis
  primer_bind 200257..200275: 99-30366-112.mis complement
  primer_bind 204569..204587: 99-16094-75.mis
  primer_bind 204589..204607: 99-16094-75.mis complement
  primer_bind 204915..204933: 99-24644-194.mis
  primer_bind 204935..204953: 99-24644-194.mis complement
  primer_bind 206178..206196: 99-16107-95.mis
  primer_bind 206198..206216: 99-16107-95.mis complement
  primer_bind 206244..206262: 99-16107-161.mis
  primer_bind 206264..206282: 99-16107-161.mis complement
  primer_bind 206466..206484: 99-16107-383.mis
  primer_bind 206486..206504: 99-16107-383.mis complement
  primer_bind 211589..211607: 99-15873-303.mis
  primer_bind 211609..211627: 99-15873-303.mis complement
  primer_bind 214650..214668: 8-124-106.mis
  primer_bind 214670..214688: 8-124-106.mis complement
  primer_bind 214764..214782: 8-124-220.mis
  primer_bind 214784..214802: 8-124-220.mis complement
  primer_bind 214838..214856: 8-124-294.mis
  primer_bind 214858..214876: 8-124-294.mis complement
  primer_bind 214860..214878: 8-124-316.mis
  primer_bind 214880..214898: 8-124-316.mis complement
  primer_bind 214927..214945: 8-124-383.mis
  primer_bind 214947..214965: 8-124-383.mis complement
  primer_bind 215519..215537: 8-125-33.mis
  primer_bind 215539..215557: 8-125-33.mis complement
  primer_bind 215686..215704: 8-132-312.mis
  primer_bind 215706..215724: 8-132-312.mis complement
  primer_bind 215819..215837: 8-132-179.mis
  primer_bind 215834..215852: 8-132-164.mis
  primer_bind 215839..215857: 8-132-179.mis complement
  primer_bind 215854..215872: 8-132-164.mis complement
  primer_bind 215901..215919: 8-132-97.mis
  primer_bind 215921..215939: 8-132-97.mis complement
  primer_bind 216009..216027: 99-13929-201.mis
  primer_bind 216029..216047: 99-13929-201.mis complement
  primer_bind 216519..216537: 8-131-363.mis
  primer_bind 216539..216557: 8-131-363.mis complement
  primer_bind 216683..216701: 8-131-199.mis
  primer_bind 216703..216721: 8-131-199.mis complement
  primer_bind 216855..216873: 8-130-236.mis
  primer_bind 216871..216889: 8-130-220.mis
  primer_bind 216875..216893: 8-130-236.mis complement
  primer_bind 216891..216909: 8-130-220.mis complement
  primer_bind 216947..216965: 8-130-144.mis
  primer_bind 216948..216966: 8-130-143.mis
  primer_bind 216967..216985: 8-130-144.mis complement
  primer_bind 216968..216986: 8-130-143.mis complement
  primer_bind 216989..217007: 8-130-102.mis
  primer_bind 216990..217008: 8-130-101.mis
  primer_bind 217008..217026: 8-130-83.mis
  primer_bind 217009..217027: 8-130-102.mis complement
  primer_bind 217010..217028: 8-130-101.mis complement
  primer_bind 217028..217046: 8-130-83.mis complement
  primer_bind 217188..217206: 8-209-333.mis
  primer_bind 217208..217226: 8-209-333.mis complement
  primer_bind 217231..217249: 8-209-290.mis
  primer_bind 217251..217269: 8-209-290.mis complement
  primer_bind 219521..219539: 99-5897-143.mis
  primer_bind 219541..219559: 99-5897-143.mis complement
  primer_bind 220817..220835: 99-24649-186.mis
  primer_bind 220837..220855: 99-24649-186.mis complement
  primer_bind 220923..220941: 99-24649-80.mis
  primer_bind 220943..220961: 99-24649-80.mis complement
  primer_bind 221722..221740: 8-199-84.mis
  primer_bind 221742..221760: 8-199-84.mis complement
  primer_bind 222029..222047: 8-198-138.mis
  primer_bind 222049..222067: 8-198-138.mis complement
  primer_bind 222727..222745: 8-195-348.mis
  primer_bind 222747..222765: 8-195-348.mis complement
  primer_bind 223576..223594: 99-13925-97.mis
  primer_bind 223596..223614: 99-13925-97.mis complement
  primer_bind 225424..225442: 8-192-82.mis
  primer_bind 225444..225462: 8-192-82.mis complement
  primer_bind 226200..226218: 99-16090-225.mis
  primer_bind 226220..226238: 99-16090-225.mis complement
  primer_bind 226468..226486: 8-189-146.mis
  primer_bind 226488..226506: 8-189-146.mis complement
  primer_bind 226851..226869: 8-188-136.mis
  primer_bind 226871..226889: 8-188-136.mis complement
  primer_bind 226968..226986: 8-187-352.mis
  primer_bind 226988..227006: 8-187-352.mis complement
  primer_bind 227570..227588: 8-185-319.mis
  primer_bind 227590..227608: 8-185-319.mis complement
  primer_bind 227593..227611: 8-185-296.mis
  primer_bind 227613..227631: 8-185-296.mis complement
  primer_bind 227987..228005: 99-16051-226.mis
  primer_bind 228007..228025: 99-16051-226.mis complement
  primer_bind 228049..228067: 99-16051-164.mis
  primer_bind 228069..228087: 99-16051-164.mis complement
  primer_bind 228115..228133: 8-184-119.mis
  primer_bind 228135..228153: 8-184-119.mis complement
  primer_bind 228207..228225: 8-184-27.mis
  primer_bind 228227..228245: 8-184-27.mis complement
  primer_bind 228235..228253: 8-183-401.mis
  primer_bind 228255..228273: 8-183-401.mis complement
  primer_bind 229050..229068: 8-181-449.mis
  primer_bind 229070..229088: 8-181-449.mis complement
  primer_bind 229149..229167: 8-181-350.mis
  primer_bind 229169..229187: 8-181-350.mis complement
  primer_bind 229240..229258: 8-181-259.mis
  primer_bind 229260..229278: 8-181-259.mis complement
  primer_bind 229269..229287: 8-181-230.mis
  primer_bind 229289..229307: 8-181-210.mis
  primer_bind 229289..229307: 8-181-230.mis complement
  primer_bind 229309..229327: 8-181-210.mis complement
  primer_bind 229334..229352: 8-181-165.mis
  primer_bind 229336..229354: 8-181-163.mis
  primer_bind 229354..229372: 8-181-165.mis complement
  primer_bind 229356..229374: 8-181-163.mis complement
  primer_bind 229416..229434: 8-181-83.mis
  primer_bind 229436..229454: 8-181-83.mis complement
  primer_bind 229467..229485: 8-180-157.mis
  primer_bind 229487..229505: 8-180-157.mis complement
  primer_bind 229563..229581: 8-143-332.mis
  primer_bind 229568..229586: 8-143-327.mis
  primer_bind 229583..229601: 8-143-332.mis complement
  primer_bind 229584..229602: 8-143-311.mis
  primer_bind 229587..229605: 8-143-308.mis
  primer_bind 229588..229606: 8-143-327.mis complement
  primer_bind 229588..229606: 8-179-268.mis
  primer_bind 229589..229607: 8-143-306.mis
  primer_bind 229604..229622: 8-143-311.mis complement
  primer_bind 229607..229625: 8-143-308.mis complement
  primer_bind 229608..229626: 8-179-268.mis complement
  primer_bind 229609..229627: 8-143-306.mis complement
  primer_bind 229650..229668: 8-143-245.mis
  primer_bind 229653..229671: 8-143-242.mis
  primer_bind 229656..229674: 8-143-239.mis
  primer_bind 229663..229681: 8-143-232.mis
  primer_bind 229670..229688: 8-143-245.mis complement
  primer_bind 229673..229691: 8-143-242.mis complement
  primer_bind 229676..229694: 8-143-239.mis complement
  primer_bind 229683..229701: 8-143-232.mis complement
  primer_bind 229743..229761: 8-143-152.mis
  primer_bind 229763..229781: 8-143-152.mis complement
  primer_bind 229942..229960: 8-178-199.mis
  primer_bind 229962..229980: 8-178-199.mis complement
  primer_bind 230219..230237: 8-119-404.mis
  primer_bind 230237..230255: 8-177-281.mis
  primer_bind 230239..230257: 8-119-404.mis complement
  primer_bind 230246..230264: 8-119-377.mis
  primer_bind 230257..230275: 8-177-281.mis complement
  primer_bind 230266..230284: 8-119-377.mis complement
  primer_bind 230314..230332: 8-119-309.mis
  primer_bind 230329..230347: 8-119-294.mis
  primer_bind 230334..230352: 8-119-309.mis complement
  primer_bind 230339..230357: 8-119-284.mis
  primer_bind 230349..230367: 8-119-294.mis complement
  primer_bind 230351..230369: 8-119-272.mis
  primer_bind 230359..230377: 8-119-284.mis complement
  primer_bind 230361..230379: 8-119-262.mis
  primer_bind 230371..230389: 8-119-272.mis complement
  primer_bind 230375..230393: 8-119-248.mis
  primer_bind 230376..230394: 8-119-247.mis
  primer_bind 230381..230399: 8-119-262.mis complement
  primer_bind 230395..230413: 8-119-248.mis complement
  primer_bind 230396..230414: 8-119-247.mis complement
  primer_bind 230413..230431: 8-119-210.mis
  primer_bind 230419..230437: 8-119-204.mis
  primer_bind 230423..230441: 8-119-200.mis
  primer_bind 230428..230446: 8-119-195.mis
  primer_bind 230433..230451: 8-119-210.mis complement
  primer_bind 230439..230457: 8-119-204.mis complement
  primer_bind 230443..230461: 8-119-200.mis complement
  primer_bind 230448..230466: 8-119-195.mis complement
  primer_bind 230498..230516: 8-119-125.mis
  primer_bind 230503..230521: 8-119-120.mis
  primer_bind 230518..230536: 8-119-125.mis complement
  primer_bind 230523..230541: 8-119-120.mis complement
  primer_bind 230526..230544: 8-119-97.mis
  primer_bind 230530..230548: 8-119-93.mis
  primer_bind 230546..230564: 8-119-97.mis complement
  primer_bind 230550..230568: 8-119-93.mis complement
  primer_bind 230585..230603: 8-119-38.mis
  primer_bind 230605..230623: 8-119-38.mis complement
  primer_bind 230665..230683: 8-138-234.mis
  primer_bind 230681..230699: 8-138-218.mis
  primer_bind 230685..230703: 8-138-234.mis complement
  primer_bind 230701..230719: 8-138-218.mis complement
  primer_bind 230736..230754: 8-138-163.mis
  primer_bind 230756..230774: 8-138-163.mis complement
  primer_bind 231051..231069: 8-175-75.mis
  primer_bind 231071..231089: 8-175-75.mis complement
  primer_bind 231099..231117: 8-142-386.mis
  primer_bind 231115..231133: 8-142-370.mis
  primer_bind 231119..231137: 8-142-386.mis complement
  primer_bind 231135..231153: 8-142-370.mis complement
  primer_bind 231353..231371: 8-142-132.mis
  primer_bind 231373..231391: 8-142-132.mis complement
  primer_bind 231650..231668: 8-145-339.mis
  primer_bind 231658..231676: 99-15870-400.mis
  primer_bind 231670..231688: 8-145-339.mis complement
  primer_bind 231678..231696: 99-15870-400.mis complement
  primer_bind 231758..231776: 8-145-231.mis
  primer_bind 231778..231796: 8-145-231.mis complement
  primer_bind 231792..231810: 8-145-197.mis
  primer_bind 231812..231830: 8-145-197.mis complement
  primer_bind 231835..231853: 8-145-154.mis
  primer_bind 231851..231869: 8-145-138.mis
  primer_bind 231855..231873: 8-145-154.mis complement
  primer_bind 231871..231889: 8-145-138.mis complement
  primer_bind 231911..231929: 8-145-78.mis
  primer_bind 231931..231949: 8-145-78.mis complement
  primer_bind 232301..232319: 8-171-247.mis
  primer_bind 232321..232339: 8-171-247.mis complement
  primer_bind 232458..232476: 8-170-373.mis
  primer_bind 232478..232496: 8-170-373.mis complement
  primer_bind 232879..232897: 8-169-266.mis
  primer_bind 232899..232917: 8-169-266.mis complement
  primer_bind 232979..232997: 8-169-166.mis
  primer_bind 232999..233017: 8-169-166.mis complement
  primer_bind 233081..233099: 8-168-380.mis
  primer_bind 233101..233119: 8-168-380.mis complement
  primer_bind 233434..233452: 8-235-349.mis
  primer_bind 233454..233472: 8-235-349.mis complement
  primer_bind 233601..233619: 8-235-182.mis
  primer_bind 233621..233639: 8-235-182.mis complement
  primer_bind 234101..234119: 8-137-340.mis
  primer_bind 234121..234139: 8-137-340.mis complement
  primer_bind 234258..234276: 8-137-182.mis
  primer_bind 234278..234296: 8-137-182.mis complement
  primer_bind 234288..234306: 8-137-152.mis
  primer_bind 234308..234326: 8-137-152.mis complement
  primer_bind 234732..234750: 8-165-185.mis
  primer_bind 234752..234770: 8-165-185.mis complement
  primer_bind 235296..235314: 99-16087-219.mis
  primer_bind 235316..235334: 99-16087-219.mis complement
  primer_bind 238204..238222: 8-157-177.mis
  primer_bind 238224..238242: 8-157-177.mis complement
  primer_bind 238770..238788: 8-155-258.mis
  primer_bind 238790..238808: 8-155-258.mis complement
  primer_bind 239744..239762: 99-16038-118.mis
  primer_bind 239764..239782: 99-16038-118.mis complement
  primer_bind 239845..239863: 8-136-166.mis
  primer_bind 239865..239883: 8-136-166.mis complement
  primer_bind 239866..239884: 8-136-145.mis
  primer_bind 239886..239904: 8-136-145.mis complement
  primer_bind 239931..239949: 8-136-80.mis
  primer_bind 239951..239969: 8-136-80.mis complement
  primer_bind 240025..240043: 8-153-32.mis
  primer_bind 240045..240063: 8-153-32.mis complement
  primer_bind 240478..240496: 8-135-212.mis
  primer_bind 240498..240516: 8-135-212.mis complement
  primer_bind 240524..240542: 8-135-166.mis
  primer_bind 240544..240562: 8-135-166.mis complement
  primer_bind 240578..240596: 8-135-112.mis
  primer_bind 240598..240616: 8-135-112.mis complement
  primer_bind 240753..240771: 99-16050-235.mis
  primer_bind 240773..240791: 99-16050-235.mis complement
  primer_bind 240839..240857: 8-144-378.mis
  primer_bind 240859..240877: 8-144-378.mis complement
  primer_bind 240983..241001: 8-144-234.mis
  primer_bind 241003..241021: 8-144-234.mis complement
  primer_bind 241021..241039: 8-144-196.mis
  primer_bind 241041..241059: 8-144-196.mis complement
  primer_bind 241198..241216: 8-141-304.mis
  primer_bind 241218..241236: 8-141-304.mis complement
  primer_bind 241242..241260: 8-141-260.mis
  primer_bind 241262..241280: 8-141-260.mis complement
  primer_bind 241341..241359: 8-141-161.mis
  primer_bind 241361..241379: 8-141-161.mis complement
  primer_bind 241488..241506: 8-140-286.mis
  primer_bind 241508..241526: 8-140-286.mis complement
  primer_bind 241601..241619: 8-140-173.mis
  primer_bind 241621..241639: 8-140-173.mis complement
  primer_bind 241666..241684: 8-140-108.mis
  primer_bind 241686..241704: 8-140-108.mis complement
  primer_bind 241733..241751: 8-140-41.mis
  primer_bind 241753..241771: 8-140-41.mis complement
  primer_bind 241842..241860: 99-15880-162.mis
  primer_bind 241862..241880: 99-15880-162.mis complement
  primer_bind 242383..242401: 8-240-187.mis
  primer_bind 242403..242421: 8-240-187.mis complement
  primer_bind 244294..244312: 8-225-281.mis
  primer_bind 244314..244332: 8-225-281.mis complement
  primer_bind 247841..247859: 99-25940-186.mis
  primer_bind 247845..247863: 99-25940-182.mis
  primer_bind 247861..247879: 99-25940-186.mis complement
  primer_bind 247865..247883: 99-25940-182.mis complement
  primer_bind 248296..248314: 99-16032-292.mis
  primer_bind 248316..248334: 99-16032-292.mis complement
  primer_bind 253600..253618: 99-16055-216.mis
  primer_bind 253620..253638: 99-16055-216.mis complement
  primer_bind 255829..255847: 99-16105-152.mis
  primer_bind 255849..255867: 99-16105-152.mis complement
  primer_bind 258554..258572: 99-16101-436.mis
  primer_bind 258574..258592: 99-16101-436.mis complement
  primer_bind 260080..260098: 99-16033-244.mis
  primer_bind 260100..260118: 99-16033-244.mis complement
  primer_bind 279770..279788: 99-15875-165.mis
  primer_bind 279790..279808: 99-15875-165.mis complement
  primer_bind 287988..288006: 99-13521-31.mis
  primer_bind 288008..288026: 99-13521-31.mis complement
  primer_bind 292661..292679: 8-112-241.mis
  primer_bind 292681..292699: 8-112-241.mis complement
  primer_bind 292747..292765: 8-112-155.mis
  primer_bind 292767..292785: 8-112-155.mis complement
  primer_bind 292857..292875: 8-112-45.mis
  primer_bind 292877..292895: 8-112-45.mis complement
  primer_bind 295697..295715: 8-110-404.mis
  primer_bind 295717..295735: 8-110-404.mis complement
  primer_bind 296012..296030: 8-110-89.mis
  primer_bind 296032..296050: 8-110-89.mis complement
  primer_bind 296049..296067: 8-134-94.mis
  primer_bind 296069..296087: 8-134-94.mis complement
  primer_bind 298950..298968: 99-7462-508.mis
  primer_bind 298970..298988: 99-7462-508.mis complement
  primer_bind 300346..300364: 99-16052-214.mis
  primer_bind 300366..300384: 99-16052-214.mis complement
  primer_bind 312011..312029: 99-16047-115.mis
  primer_bind 312031..312049: 99-16047-115.mis complement
  primer_bind 315909..315927: 99-25993-280.mis
  primer_bind 315929..315947: 99-25993-280.mis complement
  primer_bind 315995..316013: 99-25993-367.mis
  primer_bind 316015..316033: 99-25993-367.mis complement
  primer_bind 317226..317244: 99-25101-151.mis
  primer_bind 317246..317264: 99-25101-151.mis complement
  misc_binding 8304..8328: 99-27943-150.probe
  misc_binding 14714..14738: 8-121-28.probe
  misc_binding 14722..14746: 8-121-36.probe
  misc_binding 14840..14864: 8-121-154.probe
  misc_binding 14873..14897: 8-121-187.probe
  misc_binding 14929..14953: 8-121-243.probe
  misc_binding 14967..14991: 8-121-281.probe
  misc_binding 15038..15062: 8-121-352.probe
  misc_binding 15050..15074: 8-121-364.probe
  misc_binding 15057..15081: 8-121-371.probe
  misc_binding 21660..21684: 99-27935-193.probe
  misc_binding 25468..25492: 8-122-72.probe
  misc_binding 25496..25520: 8-122-100.probe
  misc_binding 25668..25692: 8-122-272.probe
  misc_binding 25722..25746: 8-122-326.probe
  misc_binding 25756..25780: 8-122-360.probe
  misc_binding 29391..29415: 8-123-55.probe
  misc_binding 29525..29549: 8-123-189.probe
  misc_binding 29533..29557: 8-123-197.probe
  misc_binding 29643..29667: 8-123-307.probe
  misc_binding 30157..30181: 8-147-270.probe
  misc_binding 49463..49487: 99-34243-210.probe
  misc_binding 64654..64678: 8-127-28.probe
  misc_binding 64745..64769: 8-127-119.probe
  misc_binding 64785..64809: 8-127-159.probe
  misc_binding 64862..64886: 8-127-236.probe
  misc_binding 64866..64890: 8-127-240.probe
  misc_binding 64906..64930: 8-127-280.probe
  misc_binding 65473..65497: 8-128-33.probe
  misc_binding 65492..65516: 8-128-52.probe
  misc_binding 65501..65525: 8-128-61.probe
  misc_binding 65508..65532: 8-128-68.probe
  misc_binding 65509..65533: 8-128-69.probe
  misc_binding 65525..65549: 8-128-85.probe
  misc_binding 65584..65608: 8-129-50.probe
  misc_binding 65845..65869: 8-129-311.probe
  misc_binding 65935..65959: 8-129-401.probe
  misc_binding 75655..75679: 99-34240-492.probe
  misc_binding 94522..94546: 99-31959-281.probe
  misc_binding 95384..95408: 99-31960-363.probe
  misc_binding 96944..96968: 99-31962-250.probe
  misc_binding 97144..97168: 99-31962-450.probe
  misc_binding 106372..106396: 99-44282-439.probe
  misc_binding 106757..106781: 99-44282-54.probe
  misc_binding 107146..107170: 99-24656-137.probe
  misc_binding 107269..107293: 99-24656-260.probe
  misc_binding 107597..107621: 99-24636-22.probe
  misc_binding 108487..108511: 99-31939-75.probe
  misc_binding 108685..108709: 99-31939-273.probe
  misc_binding 109439..109463: 99-44281-418.probe
  misc_binding 109600..109624: 99-44281-257.probe
  misc_binding 109780..109804: 99-44281-77.probe
  misc_binding 112456..112480: 99-31941-320.probe
  misc_binding 115456..115480: 99-31942-325.probe
  misc_binding 155724..155748: 99-24635-79.probe
  misc_binding 158160..158184: 99-16059-313.probe
  misc_binding 160622..160646: 99-24639-169.probe
  misc_binding 160628..160652: 99-24639-163.probe
  misc_binding 160864..160888: 99-24634-108.probe
  misc_binding 168962..168986: 99-7652-162.probe
  misc_binding 169288..169312: 99-7652-488.probe
  misc_binding 170734..170758: 99-16100-83.probe
  misc_binding 170798..170822: 99-16100-147.probe
  misc_binding 170846..170870: 99-16100-195.probe
  misc_binding 170848..170872: 99-16100-197.probe
  misc_binding 170894..170918: 99-16100-244.probe
  misc_binding 171031..171055: 99-16100-381.probe
  misc_binding 173346..173370: 99-5862-167.probe
  misc_binding 174215..174239: 99-16083-101.probe
  misc_binding 175788..175812: 99-16044-351.probe
  misc_binding 180577..180601: 99-16042-420.probe
  misc_binding 180966..180990: 99-16042-31.probe
  misc_binding 189945..189969: 99-5919-215.probe
  misc_binding 197151..197175: 99-24658-410.probe
  misc_binding 198952..198976: 99-30364-299.probe
  misc_binding 200244..200268: 99-30366-112.probe
  misc_binding 204576..204600: 99-16094-75.probe
  misc_binding 204922..204946: 99-24644-194.probe
  misc_binding 206185..206209: 99-16107-95.probe
  misc_binding 206251..206275: 99-16107-161.probe
  misc_binding 206473..206497: 99-16107-383.probe
  misc_binding 211596..211620: 99-15873-303.probe
  misc_binding 214657..214681: 8-124-106.probe
  misc_binding 214771..214795: 8-124-220.probe
  misc_binding 214845..214869: 8-124-294.probe
  misc_binding 214867..214891: 8-124-316.probe
  misc_binding 214934..214958: 8-124-383.probe
  misc_binding 215526..215550: 8-125-33.probe
  misc_binding 215693..215717: 8-132-312.probe
  misc_binding 215826..215850: 8-132-179.probe
  misc_binding 215841..215865: 8-132-164.probe
  misc_binding 215908..215932: 8-132-97.probe
  misc_binding 216016..216040: 99-13929-201.probe
  misc_binding 216526..216550: 8-131-363.probe
  misc_binding 216690..216714: 8-131-199.probe
  misc_binding 216862..216886: 8-130-236.probe
  misc_binding 216878..216902: 8-130-220.probe
  misc_binding 216954..216978: 8-130-144.probe
  misc_binding 216955..216979: 8-130-143.probe
  misc_binding 216996..217020: 8-130-102.probe
  misc_binding 216997..217021: 8-130-101.probe
  misc_binding 217015..217039: 8-130-83.probe
  misc_binding 217195..217219: 8-209-333.probe
  misc_binding 217238..217262: 8-209-290.probe
  misc_binding 219528..219552: 99-5897-143.probe
  misc_binding 220824..220848: 99-24649-186.probe
  misc_binding 220930..220954: 99-24649-80.probe
  misc_binding 221729..221753: 8-199-84.probe
  misc_binding 222036..222060: 8-198-138.probe
  misc_binding 222734..222758: 8-195-348.probe
  misc_binding 223583..223607: 99-13925-97.probe
  misc_binding 225431..225455: 8-192-82.probe
  misc_binding 226207..226231: 99-16090-225.probe
  misc_binding 226475..226499: 8-189-146.probe
  misc_binding 226858..226882: 8-188-136.probe
  misc_binding 226975..226999: 8-187-352.probe
  misc_binding 227577..227601: 8-185-319.probe
  misc_binding 227600..227624: 8-185-296.probe
  misc_binding 227994..228018: 99-16051-226.probe
  misc_binding 228056..228080: 99-16051-164.probe
  misc_binding 228122..228146: 8-184-119.probe
  misc_binding 228214..228238: 8-184-27.probe
  misc_binding 228242..228266: 8-183-401.probe
  misc_binding 229057..229081: 8-181-449.probe
  misc_binding 229156..229180: 8-181-350.probe
  misc_binding 229247..229271: 8-181-259.probe
  misc_binding 229276..229300: 8-181-230.probe
  misc_binding 229296..229320: 8-181-210.probe
  misc_binding 229341..229365: 8-181-165.probe
  misc_binding 229343..229367: 8-181-163.probe
  misc_binding 229423..229447: 8-181-83.probe
  misc_binding 229474..229498: 8-180-157.probe
  misc_binding 229570..229594: 8-143-332.probe
  misc_binding 229575..229599: 8-143-327.probe
  misc_binding 229591..229615: 8-143-311.probe
  misc_binding 229594..229618: 8-143-308.probe
  misc_binding 229595..229619: 8-179-268.probe
  misc_binding 229596..229620: 8-143-306.probe
  misc_binding 229657..229681: 8-143-245.probe
  misc_binding 229660..229684: 8-143-242.probe
  misc_binding 229663..229687: 8-143-239.probe
  misc_binding 229670..229694: 8-143-232.probe
  misc_binding 229750..229774: 8-143-152.probe
  misc_binding 229949..229973: 8-178-199.probe
  misc_binding 230226..230250: 8-119-404.probe
  misc_binding 230244..230268: 8-177-281.probe
  misc_binding 230253..230277: 8-119-377.probe
  misc_binding 230321..230345: 8-119-309.probe
  misc_binding 230336..230360: 8-119-294.probe
  misc_binding 230346..230370: 8-119-284.probe
  misc_binding 230358..230382: 8-119-272.probe
  misc_binding 230368..230392: 8-119-262.probe
  misc_binding 230382..230406: 8-119-248.probe
  misc_binding 230383..230407: 8-119-247.probe
  misc_binding 230420..230444: 8-119-210.probe
  misc_binding 230426..230450: 8-119-204.probe
  misc_binding 230430..230454: 8-119-200.probe
  misc_binding 230435..230459: 8-119-195.probe
  misc_binding 230505..230529: 8-119-125.probe
  misc_binding 230510..230534: 8-119-120.probe
  misc_binding 230533..230557: 8-119-97.probe
  misc_binding 230537..230561: 8-119-93.probe
  misc_binding 230592..230616: 8-119-38.probe
  misc_binding 230672..230696: 8-138-234.probe
  misc_binding 230688..230712: 8-138-218.probe
  misc_binding 230743..230767: 8-138-163.probe
  misc_binding 231058..231082: 8-175-75.probe
  misc_binding 231106..231130: 8-142-386.probe
  misc_binding 231122..231146: 8-142-370.probe
  misc_binding 231360..231384: 8-142-132.probe
  misc_binding 231657..231681: 8-145-339.probe
  misc_binding 231665..231689: 99-15870-400.probe
  misc_binding 231765..231789: 8-145-231.probe
  misc_binding 231799..231823: 8-145-197.probe
  misc_binding 231842..231866: 8-145-154.probe
  misc_binding 231858..231882: 8-145-138.probe
  misc_binding 231918..231942: 8-145-78.probe
  misc_binding 232308..232332: 8-171-247.probe
  misc_binding 232465..232489: 8-170-373.probe
  misc_binding 232886..232910: 8-169-266.probe
  misc_binding 232986..233010: 8-169-166.probe
  misc_binding 233088..233112: 8-168-380.probe
  misc_binding 233441..233465: 8-235-349.probe
  misc_binding 233608..233632: 8-235-182.probe
  misc_binding 234108..234132: 8-137-340.probe
  misc_binding 234265..234289: 8-137-182.probe
  misc_binding 234295..234319: 8-137-152.probe
  misc_binding 234739..234763: 8-165-185.probe
  misc_binding 235303..235327: 99-16087-219.probe
  misc_binding 238211..238235: 8-157-177.probe
  misc_binding 238777..238801: 8-155-258.probe
  misc_binding 239751..239775: 99-16038-118.probe
  misc_binding 239852..239876: 8-136-166.probe
  misc_binding 239873..239897: 8-136-145.probe
  misc_binding 239938..239962: 8-136-80.probe
  misc_binding 240032..240056: 8-153-32.probe
  misc_binding 240485..240509: 8-135-212.probe
  misc_binding 240531..240555: 8-135-166.probe
  misc_binding 240585..240609: 8-135-112.probe
  misc_binding 240760..240784: 99-16050-235.probe
  misc_binding 240846..240870: 8-144-378.probe
  misc_binding 240990..241014: 8-144-234.probe
  misc_binding 241028..241052: 8-144-196.probe
  misc_binding 241205..241229: 8-141-304.probe
  misc_binding 241249..241273: 8-141-260.probe
  misc_binding 241348..241372: 8-141-161.probe
  misc_binding 241495..241519: 8-140-286.probe
  misc_binding 241608..241632: 8-140-173.probe
  misc_binding 241673..241697: 8-140-108.probe
  misc_binding 241740..241764: 8-140-41.probe
  misc_binding 241849..241873: 99-15880-162.probe
  misc_binding 242390..242414: 8-240-187.probe
  misc_binding 244301..244325: 8-225-281.probe
  misc_binding 247848..247872: 99-25940-186.probe
  misc_binding 247852..247876: 99-25940-182.probe
  misc_binding 248303..248327: 99-16032-292.probe
  misc_binding 253607..253631: 99-16055-216.probe
  misc_binding 255836..255860: 99-16105-152.probe
  misc_binding 258561..258585: 99-16101-436.probe
  misc_binding 260087..260111: 99-16033-244.probe
  misc_binding 279777..279801: 99-15875-165.probe
  misc_binding 287995..288019: 99-13521-31.probe
  misc_binding 292668..292692: 8-112-241.probe
  misc_binding 292754..292778: 8-112-155.probe
  misc_binding 292864..292888: 8-112-45.probe
  misc_binding 295704..295728: 8-110-404.probe
  misc_binding 296019..296043: 8-110-89.probe
  misc_binding 296056..296080: 8-134-94.probe
  misc_binding 298957..298981: 99-7462-508.probe
  misc_binding 300353..300377: 99-16052-214.probe
  misc_binding 312018..312042: 99-16047-115.probe
  misc_binding 315916..315940: 99-25993-280.probe
  misc_binding 316002..316026: 99-25993-367.probe
  misc_binding 317233..317257: 99-25101-151.probe
  allele 61595..61598: deletion AAGG
  allele 75217..75221: deletion ATTTT
  allele 75367: polymorphic base C or T
  allele 88634..88637: deletion CACA
  allele 90113: polymorphic base A or G
  allele 93698..93701: deletion ACAC
  allele 94209: polymorphic base C or T
  allele 94331..94334: deletion AATG
  allele 95396: polymorphic base A or G
  allele 95810: polymorphic base C or T
  allele 96956: polymorphic base C or T
  allele 97156: polymorphic base A or G
  allele 98748..98757: deletion CTTTCTTTCT
  allele 104314..104315: deletion TA
  allele 104455: polymorphic base A or C
  allele 104699: polymorphic base A or G
  allele 106253: polymorphic base C or T
  allele 106272: polymorphic base A or T
  allele 106350: polymorphic base A or C
  allele 106384: polymorphic base A or G
  allele 107158: polymorphic base A or G
  allele 107168..107169: deletion AT
  allele 107609: polymorphic base A or G
  allele 108032: polymorphic base A or G
  allele 108668..108816: deletion ATGGAGATGGCAACACCTACATGTGACCTTTCCAGCATGGCAGTCTCAGAGTGGATATGGCAACAGCTGCACATGACCTCTCCAGCATGGCA GTCTCAGAGTGGATATGGCAACAGCTGCACATGACCTCTCCGGCATGGCAGTCTCAG
  allele 110222: polymorphic base G or T
  allele 111978: polymorphic base A or G
  allele 112468: polymorphic base G or T
  allele 117324..117327: deletion ACTT
  allele 118972: polymorphic base C or T
  allele 119160..119161: deletion TT
  allele 119316: polymorphic base C or T
  allele 119321: polymorphic base A or G
  allele 119526: polymorphic base A or G
  allele 120573: polymorphic base A or G
  allele 121527: polymorphic base A or C
  allele 126105: polymorphic base C or T
  allele 129789: polymorphic base C or G
  allele 130777: polymorphic base A or G
  allele 136942..136944: deletion ATT
  allele 143839: polymorphic base A or T
  allele 146668: polymorphic base C or T
  allele 147281: polymorphic base C or T
  allele 147505: polymorphic base G or T
  allele 148183: deletion T
  allele 148372: polymorphic base A or C
  allele 149012: polymorphic base A or G
  allele 149113: polymorphic base C or T
  allele 151637: polymorphic base A or G
  allele 151748: deletion G
  allele 151769: polymorphic base A or G
  allele 151847: polymorphic base C or T
  allele 152691: polymorphic base A or C
  allele 152766: polymorphic base A or G
  allele 153046: polymorphic base C or T
  allele 153123: polymorphic base A or G
  allele 153925: polymorphic base C or T
  allele 153977: polymorphic base G or T
  allele 154502: polymorphic base C or T
  allele 154677: polymorphic base A or G
  allele 154879: polymorphic base C or T
  allele 154918: polymorphic base G or T
  allele 155802: polymorphic base C or T
  allele 156448: polymorphic base A or G
  allele 157238: polymorphic base A or C
  allele 157897: polymorphic base A or G
  allele 158172: polymorphic base A or G
  allele 158302: polymorphic base A or G
  allele 158512..158513: deletion TT
  allele 158803: polymorphic base C or T
  allele 160172: polymorphic base C or T
  allele 160634: polymorphic base C or T
  allele 161236: polymorphic base C or T
  allele 162810: polymorphic base A or G
  allele 163007: polymorphic base A or G
  allele 164877: polymorphic base A or G
  allele 166844: polymorphic base C or T
  allele 166911..166914: deletion TCTC
  allele 167754: polymorphic base A or G
  allele 167787: polymorphic base C or T
  allele 167894: polymorphic base G or T
  allele 168346: polymorphic base C or T
  allele 168414: polymorphic base A or G
  allele 168453: polymorphic base A or C
  allele 169300: polymorphic base A or G
  allele 169451: polymorphic base C or T
  allele 169627: polymorphic base A or G
  allele 169984: polymorphic base C or T
  allele 170199: polymorphic base C or T
  allele 170746: polymorphic base C or T
  allele 170858: polymorphic base G or T
  allele 170860: polymorphic base C or T
  allele 170906: polymorphic base C or T
  allele 171309: polymorphic base A or G
  allele 171413: polymorphic base A or G
  allele 171504: polymorphic base C or T
  allele 171539: polymorphic base C or T
  allele 171728: polymorphic base C or T
  allele 171898: polymorphic base A or G
  allele 172125..172126: deletion AA
  allele 172295: polymorphic base A or G
  allele 172298: polymorphic base A or G
  allele 172336: polymorphic base A or G
  allele 173145: polymorphic base A or G
  allele 173304: polymorphic base C or T
  allele 174227: polymorphic base C or T
  allele 174397: polymorphic base A or G
  allele 179154: polymorphic base C or T
  allele 180233: polymorphic base C or G
  allele 182552: polymorphic base A or G
  allele 182733: polymorphic base C or T
  allele 182773: deletion A
  allele 185759: polymorphic base A or G
  allele 186307: deletion T
  allele 186976..186979: deletion TATC
  allele 188755: polymorphic base A or T
  allele 188991: polymorphic base A or C
  allele 189002: polymorphic base C or T
  allele 189154: polymorphic base A or G
  allele 189177: polymorphic base A or G
  allele 189604: polymorphic base A or G
  allele 190063: polymorphic base C or T
  allele 191164: deletion T
  allele 193880: deletion A
  allele 193897: polymorphic base A or G
  allele 194441: polymorphic base A or T
  allele 195306: polymorphic base A or T
  allele 226323..226326: deletion TATC
  misc_feature 4222,11245,27205..27206,27212..27213,27240,27347,27378,28258108818,128283,137062..137063,164757,172148..172150,180820,184929194460,200104,207061..207062,207949,239085,249787,249806,250156250189,250841,251114,264938,265019,265078,274640,277770,314308318680,318731: n=a, g, c or t
cgggcgaattcgagctcggtacccggggatcatctttgtcatagattgtagtaaaaataatctgtgaaaagtgactgattattgacaggtagccttgggtatgcagctcaagtaggcattataaaataaaaaacatcacattccatgtattttcaaaaaaagcttctggcttactcaaaaggtaagtgttctttaaacaacttcaatggaaaaggagtttcttccaaatgcttggagaactccttctcaagtccggaataaagcaaggtctacagagacaaagtataaataaaaccatggtgctgagctggtaccactattgggctgctaagcactgctaagcattgccttcagatgagttacctagcctttgtaaagctcagattccacagctataaactgagatgaataataatacacaaaacactaagctgttgagtagattaaatgaaattatttatgtagagcaaatagaacagtactgtaccttataaaatttaaaaccaaaatgtaaattctgatttttacccaagggtcaactccgcacaattttgcaatggacccttccccggccctccagaagctgaatatcgttgtgtatcatatccaaattcagtatcaccagggcatagagtaagtgccaactgtgaggccatagctatgcgtccactcccctgaaacacattgtgtaccttcattcttggagttgagtctttgcatttcatcctccagagtgagaatagactgcgtgttggagaggtcagggaaattatgtctttctatgtctagccctttataggtcgattatttgaatgcttgacagcatctgtccacttatctatccctgcaataataaaatacgggactaaagtagctcgtatctctagtgggagagtgcatatattttatacgtcaattctttaaaaggggaaattctttcagagcttcagaaaatatcacggaagagttaaaagaatgtttgagaagaacatgtctgagtattacctactagcattacaattttactgctttaaagtaattataattttcattgcaggatctattaaaaaggcttttacctgacggtaattcttcttgtacttacaggtcattattacaatgaagggaagaaaggaagacatgaaggggaaatgggactatttaccaagtgtatctgcatagactaaaggagacaagaggaagtactgagcaccttgattcctgcagataattatttaagaaccataagaattctttcctagcttctcataagcctgctccttcaaagggtgagtagttgacatgattttacatcccatttatatttctttattagataattttatttcaaatctagtcttattttttctgaaccttctgggatatataacattttatattatcatttatgtcatcaagaatgtagatttatattcttttctattcacatgtttatgtaaataattgaacacctctaaatgacagatactatcattttatatattgttaataagtatcttcatggctgggcgtggtggctcacgcccgtaatcccagcactttgggaggccgaggtgggaggatcacctgaggtcaggagtttgagatcagcctggcgaacgtggtgaaatcccatctctactaaaaacaacaaaaattagctgggcatggtagcatgcgcctatagtcccagctactagggaggccaaggcaggagaatcgatcgctcaaacctgggaggcagaggtttcagtgagctgatatcgtgccactgcactctggcctgggcaacagaatgagaccctgcttcaataaataaataaattaattaattaattaataaagtatcttaatgacaaatatttaaatatatataaatatttacatttacatatgggaagagagatctgaaattttaagcaacttttatccaaaaacctatttttttcaaagttcctccaacatctataaaagaagtaaagtcacttatagatctatcttacttcagggcctatgttttcctctaccatacaacactgcacattcacagacacagaaatcttttacatttctaaaataaataaaacatccaaacttcagtttaaaaaaaatggatctacagatccaccatagactaaacgaccaaacatagtcagaggtgtttacttgtttgtttcggtcttaagggaatcttcaaactaccctagagcctcgtgtatccaatgagagcagtctggacattgaatgaatggtgatgtcattaaatgagctatggagcaagatgtaagaacacgctttagagtaaataacatatttggcttctgaggtataaaaagggaaggaggctttctcaggacatttgggtacctggtccttcatactcaggaggtttttccatcttcatgtcatggaataaactatgctttaaagaaatgctgcgtcagcagaaagtgtttcaaatataaggaaattgtcatagctttgaaattatgtcaaatatcattttaactaagagagccattgtctttccatatatttatctagaagaaaatttactggacaaaataaatatagaacaacttcatgtgtagtcattaatggtcggataggcagttactataaaatatgaataatctaaaaatcattttagccatttgtttttaataaatctcacttgtgattgatttattaaaaacagggcctccagaagaaagaaacttaatacctttcctccatcattatgaaggcactagtactgacgtaactaaaattagatggcagcttgagggaggaagagatgatgtagagatggtgtgtaatctgtgtaaacagtctctcaactgtctagagttagctgtacgaatctgttgttggctccagttataagaaccaagatatgtatgtaaggacaaacatccttaatttgcttagcaagtcgtatgtatttgatagaccaccaattttattttattttattttatttttgagatggagtcttgctctgtcacctgggctggagtgcagtggcgcgatctcggctcactgcaaactccatttagcaggttcaagtgattcttctgcctcagcctcccgagtagctgggattacaagtgctcaaaaccacccccggttaatgtttttttcttttcttttcttttcttttcttttcttttcttttcttttcttttcttttcttttctttttttagtagtagacacagggtttcactatgttggccaggctggtctcaaactcctgacctcgtgatctgcccacctcggcctcccaaagtgctgggattacgggattacaagcgtgagccactgcaccagccctgatttttaaaagggattttagaatttcagttgaacatgtgtttttgaagtaactccatattgaacaggggaatcagagtaagtaaaccactacaggaaaatcaggaaggcagactccaatttatgttttctgtgtataacctactttaataaagaattaaaaatcataagagtagttttatctagtggcctagaacttgattatgaaaagtaagacaaaggaaatctgacctcatgccagtgtctggaagccttacaggaactgaaaggacccacgtggaacagctggcaactgaaactcatcttgtcaatttcaagtgtagtccctcttcccaattcaccggagaaaacacagccagctttgcatacagtgtctggtgtcaccagagaaaacacagtcagctttgcatacaatatctggtgtcagaatgaccaaacgattggcttctatccttcaggattgtgaacagagagccaaggcatacaaccagtatgcccactccgtcagctgcgagacagaggagataaagaatgctgaacattatgggtcactgctttgaagtattcagaggccaaaatagttcaaaataattgtgttaatcattaaaagtagaagaagtggaagccaaaattatgcctgcctatatttcagttttgaatgtgtggagatcagaaatttaaaaaaaagtttatgagtttccccttttaaactttgagaaaagaccataagaaccggtgttttagtaaatcatcttcaagagtaatttactcataaaaagaaaagaactcatgataccgtgtaaacaaaaggctaataaatgctggtgtaaataagattaagggaggacaaagatgaaggaaagcaggacatatcaaaaaacaaatanaataagaaattttcagagcttgaatatacaaacaggcacatcaaaagaggttcaatggaaacctaatgcaatgaatgggacaattaatgcttttaaacatcacttggaaccacagaaaataccaacagaaaaatctggtcacgtacaagagataagagtcagggttccatggatgttcttcttagatgagaaggacacttcacttttatggcattgttcccacaaatccataacccaagtttcatcatgagcaagcctcagccaaagaaaaattgagatgtattttacaacatacccgttcaggccctttaaaaatgtcaaagttggccaggcaccatggcttccacctgtaatcccagcactttgggaggctgagatgggtggatcatttgaggtcaggagttcgagaccagcctggacaatatggggaaaccccaactgtactaaaaaaagataacaaaattagccaggtgtggtggtgtgggcctgtaatcccagctacttgagaggctgaggcaggagaatcgcttgaacccaggagccaggaggtggaggttgcagtgagccaagatcatgccactgtattccaacctgggcgacagagcaaaactccatctccccccaaaaaaagcaaagtcgtgaaaaacaaagtaagactaaggaactgtcagattagaggggactgaggaaacatgaaaattagatgaaatagggtatacagtttagaattatagaacagaaagcaggacatcagttgaacaactaaagaaatacaaataaagtctattttagttaatattgttgtaccaatactaatttcttagttgtaacaaataaaatatcattatgtaagatggcaacttcaggaaaagttgggggaaagatatacaggaatactttgtattatcttagaaactattatgtcaatattttaatataaaattattagaaattgtgtcagaaacactggatgttagaagacaatggaggaatgcctcaaaaaatctacagagaacttcttttcaatctatcatcatagcatcaatcaagtatgagcttcaaattatgatattttataatatgagaataattctgaaaatttaccttataccaatattttcttagaagattactttaggatgtgctatagtcaaacagaggaataaactaagaaaaagtatgatgtgagatacagaaaaatatatagaaacaatttagaaaaataataaaaagtagtcctatgataatagcaatataagaatgtttagattggaatagaagatgaatgccctcaagagtataacctctgaaagaaaaattaaataaataaaaaaattctgacaggatacctgatcagatagagatgtgacaaaccagtatgttgaaaggtgatgacagaaagagagaacggaaagagagaggcaggaaggaaaggggaaaaaaagaaagaaatgaaaggcgattctcacaccagttagaatggcaattattaaaaagtcaggaaacaacaggtgctagacaggatgtggagaaataggaacacttttacactattggtgggactgtaaactagttcaaccattgtggaagtcagtgtggcgattcctcagggatctagaactagaaataccatttgacccagtcatcccattactggctatatacccaaaggattataaatcatgcttctataaagacacatgcacacgtatgtttattgcggcactattcacaatagcaaagacttggaaccaacccaaatgtccaacaatgatagactgggttaagaaaatgtggcacatatacaccatggaatactatgcagccataaaaaatgatgagttcatgtcctttgtagggacatggatgaagctggaaaccatcattctcagcaaactatagcaaggacagaaaaccaaacaccacatgttctcactcataggtgggaattgaataatgggaacacctggacacaggaaggggaacatcacacaccagggcctgttgtggggtggggggaggggggagggatagcattaggagatatacctaatgctaaatgacgagttaatgggtgcagcacaccagcatggcacatgtatacatatgtaactaacctgtacgttgtgcccatgtaccctagaacttaaagtataatatatatattatatatatataaagaaattccaagaaaatcaaaaggctgcatacaaatgaaatactatatgaccattatttccttcttggctttttcaagaacaacatttacttagctaccacactgaaattactattcattaattttaagtaaactggcattgaaaatatggttaatctggtttttctttttttttttgagacagggtctcgctctgttacccaggctggagtgcagtgctgtgatcttagctcactgcaacctctgcctcccaggttccaacaatcctcccacctcagcttcccccagtagctgggattacagctgtgtgccaccatgaacagctaattttatatttttagtagagatggggttcgccctgttggccaggctggcctcgaactcctgacttcaagtgatctgcctgcctcagcctccccaagtgttgggattacaggtgtgagccaccgtgcccagcccagaaatgtgtttagtagtttgaaggggcaagtaccaggtgctaagagttcacaggggagggatactggacttagaccttcggaatcaagaaaagctttctatagaaagtactgcctaagctgaagactgaacactgaccaggctgaatgaaagatgtagtgctggagaggatttcagtcagaaaaaacatttgagaaggtccagaagaaaaataaaacaatttatttcaaggtactgaaataaattgagattaaggggagtgaagagtcaaggtctggagaggtattgagttgtcaagaaatacagtttgagaggtaaaggccatattaggaagtaatatatttttaaacttttgaagcttattctaaggctaataacaaagtggtgtaggcaggaaagttgcagttattataaaactttcagaaagatttatttaaattaattggaattgagaaagaaaggcattattttacgtaataaaaatatttatttgttgtgtaaaaaataaatagtttggcctagaggagaacagggccagtaaggaagaggagaaatgcatagatataaagggtgttaggataaagcataagtaagacttaatgataatttaaacttaaggaacaaggaaaatgaaggagtaatgaatacttgagtcactttgtagatagaggcaccaatcactcaactcagacagagtagactagaggtggttttggggaagctaaagactccacttttagatctctggaatatccaagatgggaattcaattaggctatgatttcaagttcaaacaagagaaacgggatggagatatttttagataccatctgataatgattagtgattgaagccatgggaatggatattttgtcaatgttcttttgagagctgtatccttccgtagttatctgatgggttttttaaatggcgtaaaataatcagtaatttagaagtttctataaagaaagttcggctacaaatacttatcctttctctttcattctcaaaccatgcattaaccacctattaatgtgtttagaaaaacagtaagtaattcagggttcatgctgacagagaagacccacataagcaaacctcgctataatacaaggagctaaattccccaatataagaatgcagtgtgctctgtgggaatatggagaaacaaagataaggaaaacctaggcagaaatagttcaattgattgttatttcatactgagacaaatttgccaagtataaactatatcctattacaaatttagatgctttgggccatgggtcagctccacggcgacacctacactgaagttgtatttaagctatctgtctggatcacttggttcacaaaaatgtttggattacaaaaaggaaatatcatacaccttggaagaactggctcattagtcaagatgctgcttaccagttgcctgggttggctgctgtggtaaagsaatatcggttggaaagccggggctggaagtcggggagaggctgtcttctatatcttacatttgctatgtctttggaggaaagatgctttcggcagtgttccttaaatttaaatatcttttccttttggactcaagggtatgtttattcgacttcatcatatctaatctcctagaatattattaacctgaagttattgtcagtatcgtatgatatttattgaataacaatatgctctgatactgcatatgaaatgaaataacaaatgaacctcccttactttaacttaactactaattaattagaaaagaaccttcactcaaggggtttggaaaggtccaataagggaattaacagatgagaatttaagagtacctgaacccatctcgatttgagatttacgtgatgctgggtgattagtgataagaacagaatgaagtcagctcaggaggcatcgtgatctggaaaggagggagatatttcagtgaataattgagaggattcagacaaagtcatatgagagaagcagagacagacagagggcaggagtcagtggatatgagaatgatactaggaagatgaagaatggactgatttgtaaagaaattgagacccaagttatactgtgttaagagataagttaaaaccattaaaaaatattgggagatcctgaattgctttcaagcctagtaatttgatgtaagaaatagtgagaaatgctcttgatgttgtgtctgtttcagggaaagttttgtggagacaatgaaataaataaaatagcatatttagatcaagaggctggttttctttttcacaggaaacatctaagaaactgttaaaagggacaaggtttgagtgttagaacgtgaaatagggctatggtaataaattgttaccattccgaagattatcaaattatctcccagccaaaaaaagagtttttaaacaaacatatgaagatatacaatataataaataaactagtatgtttatttcagattcaaccattttaaccacaaagaacaaaacaacctcaactgagagcaggcttgatttatgtaagcaaagatttggatttgaggcagtgaatataggaggcattggaaaagtttgggaaaaggctggtgggctttgtgagacaaagtgaccatgccatgagaattgtgaaaataatgtagatgtggaatcctgtaacaatggcaattagtgatgaagtggtgacatgggaataaagagaaatgggtcaacgtggatcatttttagaaggaaaagcactgaaactttggaatgagattatgaaaaaaagaggatgagaaattatgtttccaaggtttattgcaaaagctgtgatgatggcatacctcagatagaaatgaattattttaaaggaaaccagtttttagagaaagataatgaatccaattttgaacacattgaattcaaagtgacaatccgtcatccatgcagactaccatgtagacagataaccaaatagaatagaaacacccaccatatataataaaaccacaggtgcactcattgagtgaaccagtacagataaactatattgtaggggctctcacatctgggaataggaagactcaatgaaggcaataaggggaagttaaaaagaataagataaactggggaattcaagaagatcttctttggcttccataagatcctagactgtttctaggaagcagtcacagttcagccatggcccagaatggtgatgaccgagggcagggccatggtttggtgctcagagaccatttgccctctaggagcaactgatggagagaataaattggggagagaataaatctagggcagttgaaggagagagtaaattgtaaaccaagaatgccatagctaaaagggaagcagcaggcaagtttgcacttttgaggagaaattctaggaagggatttctccacatttccattttaggccagaagtctttgacatgctagagagaaagatggattttttttttaatgaataaatgagatagttggcatttttggcatttttggcaaagaaagatttcattttcaagaccaaaatttaaacagcaatatttagcacaaaaaatgcttgtcaaattcctgctgaatttgaaagcaacagcatattaaagctttttcttctttcctgcaatagctgatgttcacgatacagtattcccttgccctggtgggagtatgtcctcgcttatcctggtgggaatatgttcccctttatcctggtgggatatactccctcttatcctagtgggacatgttccaagactcccagtggatgcctggaaccatgaatggtaccaagccctacacacactatgttttcatcatatacatacacatgtatgataaagtttaatttataaattaggcatagttagagataaacaataatagctaataataaaatagaataattataacaatatactgtaataaaagttgtctgatgtggtctctctttctttcaaaatatcttattgtactgtactcacccttttttgatgatgtgagaagataccatgcctatgtgatgtgatgtgatgaagtaaggtgaatgagaaaggcatcatgacgcagggtggcctactattgacctaataagcaggttgtgtctgcagcatggagactctggaaaagggatgattcatgtcaagggaagaattgaatgggacagcacagattttatcacattactcagagcagtgcacaatttaaaacttatgaattgtttatttatagaattttccatttaatattttgaaaaggcagtgtgccacaggtaattgaaaccacagaaagtgaaactgcagatgagggaggactactgtattcttagagcaattgtatatcattggaatattattgatagtttaatgaaaaaacaaattagatcaacatgggntggtaccattaggaaagatggtagattttcaattcaaattcacaactttcaaagaaaaatattgtgagtctctgctatgagatagatattgagaaatggtgtagatatatattcgtctgttttcatggtgctaacaaagacacacccgagactgggcaatttacaaaagaaagaggtttaagagacgcacagttccacgtggctggggaggcctcacaatcatgatggaaggcaagaatgagcaaatcacgtcttacacggttggcagcgggcaaagagagagaacttgtgcagggaaactcctgtttgttaaaaccatcagatctgatgagacatagtcactaccataagaaaagcacaggaaagatccaccccatgattcagttacctcttaccaggttccttccacaacgtgtgggaattgtgggagttacagttcaagatgagatttgggtggggacacagccaaaccatatcaagatatcagcagaaatgagcaaaaaatgagtgattttaaaattactcggtttattactgacattctgatgtgcattccttaagagataattacattttacacctaatgccaaagttcttacagttcaaactctaggagcaagagctgcccaagaaccattgccaaaaagttacagggagagcctcagtgtttgtttggactctccagctcctaccttcccctctctctttccttgctcttctctctccatcattcttcccagccttcccaggttctggggactcagcttccatgatgctgcctcagactttctatccatacggtattattgcactgtgtctcagaggagaagagggaggccatctggagaaggtacagggcacctcagcagtgtctcttgcctgtccattgctcctgcttcctgatccctgccaggggcacacctggagaaacttagaaaacccttcagaaaagagtaacagagaaaactcaccaaatacaagccattcaatgtgccatcataggttcaacccaaatcttgtttcaggttacagatagagaattccagtgcttcttatcagctttacgaattttattcatgcttcagaaagttgctaaacagtgtaaatgaatatttgggagaagaataaaagaactactccgaaaatctgaaaagagttaaaataaattccagtgcactttgattcttcctttataaatacaaaggatttatggtcttttgcatcagccagggtggccactgggaagtcagagtttatctatatccatcttcacatttattacaaccacacacagcatttatcatacttgtattcagacatgatgctattattattttccactggcatggcttttaaaccccaaagcattagagacagatagatagatagatagacagagatatttatacaataaaagaattatatatataaataaaatttctttatataatgaagaaattcatataaaggaatatattatatactatatatggttgtataaaattatatattatacattatatattatatgtaatttacatgtttataatttataattatattatatataattatataatttataaaattatatataaaaattgtgtatattataaaatatgtaatatataatttataatatattataatttatatataatacataatatatattataatttatatataatacataatatataatatattataatttatatataatatataatgtattatatatatgatgtattgtatatatacatacatatttccaccaatgtgattttaaaagactaccataaactcactgaaaagaaaacataacagttggtttccaagacatgaggacatcagttggaataacgtttcttccatagaattaaatgcatctctggtgtcttggaaaggcaatttcctctcaaatgggtaaagtgtttgtactaatactgtataaaaatgaatacaataaaataggcgcaaagaatctcacaacttaaaacatcccatctttattctatagctgtaagctcagagagacaatgatcccatgattttatgggagtagaaaaacactttattgagtgttttctatgtatcagacactgtgtacattttgctatgttgtcccgattttattaaatgcagtccttttcctgttcagtgtcaccattcggaggtttttttcaagacactctggtgctccatgagatctaatctccattaatgtgacatatatgctgatattatgtaagtgtgtgtgcatacgtacactgacacacatcgtttgcatttgtaatttttttttacccagttgcctcataaaagattaaaatggaagattagactccattcagagtttgacaatgcctcaataataaatcagttctcatcatttgaagaactatgaggtggaacaaaaactgatttgagattcataccgttgtatacctactctttaaaaaaaagatgcaatttacacatctgcaaatcttaggaaatggcttagagaatttgcatgatttgggcacatgaagccattttagcacataaattccttcctttcatctctaacgggtgtagaaaggatacaaacatattttttgcagatgatgtgaattattgactggcataaatagcaactcacactaaatgcttcagaaatgtgttttttaattgagtgaagatggaataaaaaaatgcaggaaaagtcctgttctatgagagctgaagatatggaattagatacagtatttgtgagtgtgtgtgtatgtgtgtgccatagctaatattataatttttggttggtcttccttgtccatttaatgtttgcagcatttgttgatggatttttactaaatgatgacaaaataatgaagcagattagtaagaaaacctacaaattgtttactagatcttcactatctatattaaatagatgaactaaaaggtaaatatggatttttacctactaaagaaaactactagaatttattgcactttaaaaatatcatgtagtgtgttgtaaaatgaacccaatcagatgttctcttaaaggactatattagggtattgtaaatagttttcctaaaagtggattttttttttttgcaccacaattcaaataatgccagaattgccagctataaaccaaatgtgaagtccatgagcttgaaaagcccatagtgttcacggggatcagtccctttttttacactggaaacagccccagaaagttccagccagtaatgaaagatggtgcacaatggctgtgacagaaccgtgatcaaattcggtcattgtgagtcttctggccagcgtcgattttctaccacatgtgttttgcggcctccataagatgttaaaggaacactgaatcattggcaatccataatactcagattcttggcttagagagattatttaccccggggtgcctttctaacataaacactagccttgggtatagtaacagggagtwcatagaayagtccaactcatatgaatgcaagaaattataatgtgattaatttttttggtcatttcaatttattgaaggtaattcagttggctctgtgaatgtatataggaaatttagaaatattawtatgtttttatttttttcctctaggttaactgmagtgaatcaaactattggattataattccatgaaggtaagaaagagctccagatgkttttcatcctatcaccaggacctgcacagtatgagtamctggtgcataacaaactttattaattatcttttctctctttctttccccaaccatgtgtatacatacacaygcacacacacayatatatrtacatacacatatatacatgtgtatggatgcataatcacatacacacgtgtatatatacacatatatacatgtgtatgtacatactcacgtacacatatgtgtatatattcacatatatacatgtgtatgggcatatacatatatataatacatgtgtatgggcacattcctctatatacacacatacacacacgtacatacaataaataaatggttgaatggcaaaatgactaaatggatttagtacaacctaatgatatgccacagatttgtcaaagagccctggaattgagtaaaaatgaatgaactaaattccaagatcttttacaacctatgatttcattccagcagaaatttgtaaatatgtgtaccatagatttatacaaaacgttaatggtggcattatttggaatagctccaaatgggaaaaagcccaaatgtcaatcaacagtagaatggatggattttggtatatccatagaatggaattctagaccacagttaaaatgagtagattattgctacacccagcaacatggatgaaactcaaaactccttgagtggataaagccaggctgtttacgattacattctctgtaagaacttttattcaaatttcaaatacaagcaaaactattctacagtgagacaagtcagtggttacctttggcagttagtgtacccaggctggggcaggagggaagtttctaggtgatgaagatgttttaattcctgatctaatcctagctttactgatgggtttactttgaaaaattcatcaaggtgactatgcactttctgtaggtttacatgaaaatttcaatgacacacttgattgtatgactttggatattacttttcttttctgtgccttaatttcctcaattgaaaagtgaggaagagaatgcttacctctaaggattgacatcaagattagtggctgagcacggtggttcacacctgtaatcccagcattttgggaggcagaggcaggcagatcacaagatcaggagtttgaaaccagcctgggcaagatggtgaaaccccgtctctactaaaaaaatacaaaaaaaaaaaaaattagccaggcatggtggcatgcgcctgtattcccagctacttgggaggctgagtcatgagaattgcttgaacccgggaggcagaggttgcagtgagctgagatcacgccactacactccagcctgagcaacagagcaagactccatctaaaaaaaacaaaacaaaacaaaaacaaacaaacaaacgaaaagattagattagcaagtagagtatgtgtaaaaccacctggaaaaatgcctggagtgtgtgttcagtatttaattgtagaaacagttaccttcataaacaacaggacattgtgggaacatctgttaattaccgaacagtctttttaggaccccctggggtttgtggatagtaatttttattaataacacctttatatgggctgaaatcacaatgatactgtgtcaaattaaccagcagttaagagctatgcttcttctttttgccaatttacttgttttatttgtttttaattgacaaataaaattgtgtgtatttatcttgcacaacaaggtgttttaaaatatgtatacattgtggaatggctaaattgagttaattaacatatgcattacctcacacagttattttaggaactacgtttccagaagtctgtaaggtagatggattgatatttttaacctgattcattcattcttcatttaacccaggaattttttgagggtcagtttcagagcatgcgctacactaagtgtcgggattactaacatcaaggaacagttactgacacaacaaatcgatgtgaagtcctaaaagagagaacatagacagacacataaaaacatagtataacacaatatattaaaatatacacaacaaaacatataagataaacacagaaatgtttggagcaatgaattagatacttaactggtttagaaatgttttgaagaaatgtatgctaatatgtcttttgttcaaaatttattaattatataattaacttttaattatgataaaatacataatataaaatttattatcttaagtacttttaagtattcagttcagtcatgttcactatatttatattgatgtggaacagatctctaaaacatttttatcttgcaaaactgagactctacaccctttgaacaaccttccattaatattgtttacatgttaacacatttcattatattataatgtattatcgataacatattatatataaatatatttataaatatacatgaaatttgtatatttgaagtattagtttcaaacaatgctacatatatctaaggcttctagtcctatattggacttacagtggaaatctgggaaattggccagcatttcagtgtgaaggaggaaggatgccgtgttctctcccatctgtttcagaaaaccagtgtggagaagatgcataataggcttgacgcattttttataatgatgtttatattttcattttctttttcatagtcacaatgaaagtgaaagcaaaggaaagagctaatgtcccacaggccactgggtaatagcgaactgtgaagggtgtggagtggactcactgggagacgggagcccatggacccctccccagctcctttgctcccacagcaatcttctcccttctctttctttgtctcacagtctagaagagtgacatttcaaaaattatagcagcagaggtgtttttacctatagcaaaagatgtacatgtaatcacattatgacatactacaaaacaggtaaaaacagtagtttttagtacttttataaattcaaacttagcaattttccttatttcaacattaatatcaataggcattaatgccagttttttaatgccagtgatttttaacctgctgaaatttgttttataacttactgcggggtaaatgagatatttagttatacttttgaaagtattgcttgtgtataaaacaccttgaaataaaagtttgaagatgtcctatgagttgctgtgaaaagagtagttgtgaaagtttcaaaatgacagatgcattttaatggcagagtaggagttcatttatccaaaaaagagggaaatacagctcaaagagtaaagcagatgcagagaacagcaaacaacggtcagagcattgtgaatcttcggctttgatcttgagtacctagctagatattactgtcaacggctaagattaaaatgtaacaatatcaggggaaatgcatttgagaacagtaaaacatttattttgtacatatatagcttgaaatgcatatgggaaatgtaggtggagatttttagtaggcaatagcatatgtgagtttgaaatgtaatgcggatatataatctaaaactggttctcaattctgactgcacattaggaaatttactgcttaaaatgactaaatctcaggcccaactgcagattgattaaattaaaatttatggggatgtgcgcctgaattttttttttcattaaaaaaaaaaaaaaaagactccccaggcgattataagaaactgccagctttggaaactgctggcctacaattagtgtcaacgtcatcattgtgtgggctgttgttggatggatgagaacaaggatggatgagaacatctagagagtgcaggttgttcctcttcttgtcttctatttgcccttcagatctgccctttcatgtagtctgggcaccagagcaccctgagcccagtggactgcaccagtggactcttccatcctcagggttttggtaagcaccatctagaggaggcatagagagaaaatcagggacccaggaaggtgaaaacaggttttgttttcccagcttcctttctgctgggtcaaggggtaactgcaggttgagggtcatcctcagtcaaaggccacagctgcagcaggtgcacctcttcacacagctgcttctagagtctgcttagctgcttcaggtcaagggatgatgaggtctcccaactgttgctagctctatagttctcagccatcttcagttgattcccctaaatcctgcctgccccttcgtagacagtaccttcattaaatattcctcattggttaaaaagtagtgaccttgtgctgaatattctatgccaagcctctgcctgctgcagtaacataagaagagttgtggctgaagatggaaccaagagagaaaatgacctttaaaagatgtaacgaggtgcccagggaaagttttggcaatggaatctgagcatgtagagtttaaatgtaagaacggaaaaatatctgttgtatttgaaaggtcacgaaaggcttcttcccgagaggaattttagtggtgcgctaacaaaaatcagatggcaggggctggggcatcaatgcaagtgaagaaatgaagggtggttatttgacaagtttgatgataggaggaataaagaatttggatttattaaaaataagacatggagctaatcaattgagattgccaaactcttttaatgaaaagtagctgtgctctatctccagcagttgcaacagagcactaataatatcaccgagactattgatgtgagggcaatatacatactcagtgctgtaaaggcttagatttttgatagctactcaaggaagaacacaaagaattaagtcttgatttttaaaatgaacaaagatataaagagagaaaatacagaatgtatacgaataatcaaaacatatgaaacgacagccatctctggtaatcaaaagaaggctactacaagcaatgatatatgttttgccttataacttcataaagattcagaaaatgggccatagccactattggcaagaaggcaaataaagtccatttttggtcagaatgtcaatttatgtatcttttctgaagtctggtctttgcactcttacccttttaaagaaaacattaattgtttcactgaagctctgagttcatatggccatgctctcctgcccaggtgttctctcccttaagccttctcttgagcacttatgtgccactcatcatcatgacttcagtccttaaagtttctttaataccactggactataaaataggactgacgaaaagacccattcaacattccattgaaggattaaatgctatgttttaagatataattttataacatacatctatcatgaaatccattgactcttcacaattagatgctcttacatagaaaacatagttacttacaaagtcatggttgaaatgaatctctgctgtaacgccattacatatccctaaaacatatttaagaattatgaagaggagcattattgaaaacaaaatgtattgacactaaagagtaactattttaaaaaggtaatatcatgatactcatatgaatatcaaatgaatgcatgtcaaatattttatttaactctttaactaatgaagaaatgggtatgatgctacacccaattcaaggtagaattcaaaattcaaaataaacacatatatacataaatcaggaattttgaaatgaatgtacaaaatgatgcaaaactggctttttccatggagattggggtcgttgtccaggaatcagtagttatttccagggacaaaattcatttgcatttctatgggcaagtgtcatttaaactgcaatcagttatctacaatttatggaatcgtaaccactttaaaaaagatgaaaacagttaacctgaaagtttctcctgcactaaatgagaaagaagctcagttatttttaaatttgcttatttttgtcttgttcttttttaatttcacaatatttgactgacagtaacttacctgatagtgataaatcaatttgtgccacatctcatggcatatcagctttctgtgtctttgtccatctcaaacaaccccacatgcctacctcaacatgagttttatctcccttcaaactggattaatggtatccatgttacatgactttatacgtgttcttcactttacagcaaatagttatgaacaattaatggaacacacacacacacccagataggaatgggaccctctgagttttgttcacagagtctatactcttttctattgtgtcatataatggtgacaattcaattaggtggcctatgtccacaatccatggcataaacgccggtaaatttacagattctccgcatcctatttggcaagtgcttcagtgatatctgtagcctgaagagaaaagctaagtttttcctatttctctctcttctttccttcccttttcttttgaatttcctaaaacaaaggaagaaaaaggaggggaagaatttggcaatgtgtcagttaatttcatcaatgtagacaaagttaaattaggaggctgaattaccaagactggctgtttccattgatgaaattaaatcaggtaaattgccagtgcttcacaaatgctgtctcaggtgtgactgaagttgtgattgattggaaagtactcacagagaaaacaagtacaggaaaaacagcactattccaaaatgcagaacaaaaccacacatatttaggctttacagttttcgtgctccttcatattcttactttgatgtatttctgccttttaatttagscttttcctaaaaaaaatagtttgctttacagtttacaaagtaagatatgctttaagaggtagaaaaatgaggcaagtgaaaatgaattaaaaaaaaaaaaagaatccaggagcaaagtcagtccacaaagtttgtctgtgacatcattgtccttccaaacaaggagcttcgagttcaactccaaacattagcagtgcagacgggaaaatgcagtgaccaaaatcagagtccctgggtgaaaagcaagccatttaataggaatgaaagagtcctgctataaatactacagaaaataattttcaaatctactatcctaaggagaacactgtgcaagataatgaatatcatctttagaaacatcttcttgtaattatttcttaaaatatccttccagacaaagcaatgacatcattacaaactccaacttagcaaaacgctttttggaaaaaggaaagtggaaggacattgagtgatgtccacatatgtagctctctgatgatttgacttcatccaagaatcgtgtggaaacagctagaatggggtgaattttatatctcccaaacagtttttcataaatatcattttatttgactaagctttcaagtgtgactcaatgatagtaaaggggagaacctaattcctgacaattgcatgagatgttggtcttcagtgttgccagttaactgagaaactatgttaataatcagccgcgttagcccttttctgttagataattttattattcgcaattctctttgatgggtattaggtttagacaattgaccagcaaactatttttttttgaaaatgaccacaaacatgttaaaaatggatgaaccctgagaggagacaggaaaacagcacctaaaaatagtagaaggatattatttctctgccattatggacttataacataataaacatttagttggttcacttttttagtatcaacacttttattaattgcttctttttttacaaatttgattttattattttgatacctactgatctctaatttcttgagaaagtctgtcttactttaataaaatgacatacagtgcattttaaacttaaatactgtatattcatatttaaatctgagattattgggacataatgatataagaatttatataaggccatcctctgaatccatattcaattaaactaaaaaaggatgtccgatttaggaatcccacagacccatcagtaatcaggcaagtacttaacagccatcctatcattggtctctctagtttttatttattcttgtagtattagcagatgatttctataatgttgatcaaatcagatttacgatctaagttgagttaaatctcagagaatcaaactccattgtggaatggaagtttttagtttcttatatatggcaatattttgtaagatattttcataactaacaaagtattctcattataaattaagtacatttctcccttaagctttttaaaaaaaatgattttagaaaattcctgaaataagtatcaaaatgcaagattgtaaaatacgttttgataaatcagaaacattcttattaagagttttctttattgataagttatacttctatgtttataaaatatgttgtattgttaaatgaagccaatgaaattgatcaagggttaggttttagaatatttctgtccagagctttgctcctccaaattctgtcgtgttagaattttattttttgactacaggaggatagaagcctaaaacattttaaaactacataatccgtttttaaaattacacatgtaaaatggtgtgcacaaataaatactctgtcacacaaacatgcacacagagcataaacacatgtacacacattacatattaatgcttcttctaggacagagattaataagtagtagagaaaaaagaattacagatacaatctcaaagcttgtcatatttctacaaggtaaatatatatctcagtgatagtgctatcaaaaccataccatcaggttaaagaagtgggtaaatattatcagaatttaatgtgaaaacaggattatattcctactattgcctggtgacatagtactcaacacattttttttcgtgttattcatgttaaatgttaatctgttaatttaaattaaatcaaattaaataaaatctgttaaagaaaattgttcaaatagcttctccctaaagttttctttagttcaaaagattctgatgctatattttaacctacagcttacaaacaaatttgggtcttttaaaacttccattccctcaattttagtaaaaaagaaccctacttttataacttacattaaacattggaaataatgtataacttacttattagtcttaactttgggagagaagaggtttaagtacgtattttaaaaaaaacaacagaaatgagtactcatgataaatagtatatgcacctaaaatatactaaaattaatgagtacaaatactcattcagctctcaaagtaactctcccaactgaataaacacgtttaaaaatattttaatgtatttatttgtgagttacacaaatccattagtttaatatttagataatatgacaatgatatatgagacacaatttattttaagaatatttatataataaataaataaataaataaataaaaataacataacctaagtataccttagaaaaactatggggaaatgttaaagataaggcttgggaactttgccagcacagtgtgggtatcatagtgtaggtattcttatttcaattaaactagttgctttcagtttaaaaagtagatgattttacatacaagtttgcacttctagcttctcttttcaaaatgagttcaggccttcccatcctgacaccttgaaaaagctgtggcgaggccgggcgcggtggctcacgtctgtaatcccagcactttgggaggctgaggcgggcggctcacgaggtcaggagatcgagatcatcctggctaacatggtgaaaccccgtctctactaaaaatacgaaaaattagccgggcgcggtggcgggcacctgtggtcccagctactccggaggctgaggcaggagaatggcgtgaacccgggaggcggagcttgcagtgagcccagatggcgccactgccctccagcctggggaacagagagagactccgtctcaaaaaaaaccaaaaaaacaaaaaaaaaaacaaaagctgcagcgaggccgtttctgaagatggcgggtattgggcactctttacttccttgactctactcctgcactctgagactgaccgtataacatttccgattttctttgatttgtgctattgtttttcttatagttaagggaaatgtgaaatattattgtacctttgtctgtcaaaatttagaaaaatgaaaaatagaccaaaggtgggagtataattcattgcaaaaacttgatatcctaagctagtgtgtcaaaagtgtacaatttcgagcattattatgaaataaatttagtaagatctatcaccaatatataagaaataggatacaaagttttatgaactaaaaagaaaattctcattgaattgttttttaatcaaattaaatgaagctacatcgaaatatttaaaaacatgttggcaatgatgagtctataaagcaatttagtgggtataaccctcccaatttgctgatatgggccctgcctggttttgggggccttgaatctgcaatccctggtggaggacaacacccctgtttctccggacctgagagtttttcttttaatctaatttccttcacattttaatcattagcttatcttcaaactttttwaagaatgatcttaacaaattaaaagtaytttacaatgtattgcatttactatgtttgaataaaacattattttgccactatcccaaaggattgttatatttttctattttagtaagtttattgaagacaaacaggccttgggccgctgcctctgtctctcctgccttccccactgaatctccagcccacattcacaaacraagacaaacctgtgtaaactgaagcaccacaaaactacttttatgaaagcagamtggaaggtaagtgtcataatctgttcccccttgyactgtagcataaactttatcgaactcactgcagcaaatacctttgtctttcaccaagaaatggaaattgtttggtgtaattgtgccttaccttcccgaggtatatttctggatttgatttactgaattcaaagttgaatgattcaccaaacttcttggttttcaatgcttaaagtcccaaataacttttcttaaaatcagagctgccaaagttaggaatgattttaatatcaattcccgagaggtgtagaagtagctactgtgctatttctcacactttatcaaccaaagtcaccttcacaagcatcctcaggatgaagacttcaataactcttaggctgtccatttctctaatgcacatttgtggttgtcagaaaattttttttatattgatttgaatcaattgatccatgttttgcccaccagaacaacagaaaccaaatgtattctttttgtagtacttttcatttttaaaaacaattactagaatcccctgagtcttcttttgttctgtggtccttcccccaggacagtgtgtccaggtggactgcccttccaaccctctcctctctttcagacaactttgtccatgtccctttgcagaggccctgggcagagattcccgccgggaggtctgctcagaccagtgcacgctgaagctaatgagtcattttatatggacttggtgatgatctcagtgtcataaaaaggagattccattatttctctttcaaatacagccctagctgctgaggcagatctctctgattctgtattttaaattgatttttgaatttaaattgagagatttcaggtcttatacttttagagccaaaagagaacgttcacatcaactggagattagggttaatgttccagatcaacggccaaatagttacgtgggcttgaacaactgtcccagttggcctcctgggacagctgtttgctgtaatatgggaataggaatgtcatctccccctgccttacaggactcttgtgaggatctactaaagaatacccataaaagtcttttaaaaaggttagagaacagaagatgtcattggtttatacgtgtatcctgattccactccttccatatcattgtctcttcgtgaaaaccagacttctctaaaagctcttgtattattattttttttttttccaaacaccaaccaatactctgacaccatctgtgtggacagcagttcaattggattctaactaaccagagttagagaaaaccccacgggatgagggcccaatgccacaagattgcccccatatcacatgccagccacaaaaagagtgccagccttcctggtctcctgccaggcccactacaaacacagggttcccaccattcccacccctccaaatgtgacaactttttagaacaactcatagaactcaggagaacactacacttactgattttttnnggtttnnattatgaaggacagttcaggaccagtncaaatggaagtggtgcacaggacgggctgggtatggggtaggggaatgactgggagcgtcctcaccctctctgggggcaccaccctcccagcacatccatgtgtttngccagcttggaagctccttgaatctcttttngctcacgagtttttataacccaatctctaataccctcctttccctggaggttagggggtatagctgaagatttccaacgcctaatcaccatttggtctttgttgtgaccagccctatcctgaagctatacagagggccgcaccctaggttacctcagtggcataaacacaggtgtagtagaaaggggcttattatgaataacagaaggcactcccatttctgctagtcccgagggttttggtagttctgtgccaagaacaggggaaaaagatgaagtacaatttttattacaccactgctgtccatactggttaccagcattttctttggtctctcctcaaatgacaccactctccgctgccctgtcacttccctgaacagttctcttggtgattttctctcctcgtcctactttccctttcatgagcacaagaagtagtcaagcggtgaaccctttatcgttcttgaagcacctctcactttggagactttaataccacaacctgcttgttttccttccatgcttctgactcttcctgctttgtctccttggagatatattagtgagagaagtaaaatgttgcaactggtttaaatgataatttgatatacagatatatgcattctccaaggcacagaatgtatttatattgctaagaaatgtgctaaaaagtggagacaaggcctgaagaatccctgagcagacaacactagtcaggcctcataagtgacctcaaccttgtttgatttgcaaacataagtgaatgtcagcttgagctatttcttgtaaatgcctgtattcaaaacagaacttaagcttaaccagtcagaagcagtctactcacttataatcctataactggggggactttccgaaggnatagatcaaataaggcaactgtataactgaaaccaaccaaatgctttctctgatttacttctgtgttgttctataaaagcctcctctttctgtttcctcagtaaagctcctgaaccagttctactttggaggtgcccaattcatgaattgcttgctcaaataaactattcttttaaaatttattgggcctccatttactttcagataacagtaattatttgcatgcctatggaaggaaacattggtattactgtcttttttttttttttttttacaatttaagttctaactctacagaattgtaaaataacataagaattaacccaaaatgtgcattcctatcaagtcagataatcacccagaaatcctgctaaaataatttccagaatttcactgaaaggacacctagtcatttcttttgcccatttcctgacagtatctccactagtaataaaaataatattgaaagaaaattcttaatctcaaacaggccaaggatgcccataaggtttgacctgatatttacatagttgcagaagaatttaaactaaccatatgggcatctttgagtttattctgtagttcttaatcaatgaattattaagcaactactaagaccagagaataaacttatgactaggagttttcaaaagaaatctttgattggtcttctaaaaatccctatgattttcttttctgtattagttcattttcacactgctataaagaactacctgagactgagtaatttatgaagaatagaggtttaattgactcacagttctgcaggcttaacaggaagcatgacttaggggtctcaggaaacttacaatcatgccagaaggctaaggggaagcaagcacatcttaccatggcagagcaggagacagagcgagtgaacaaagggggaagtgccacacattttcaaaccaccagatctcttgagaactcactcactatcacaagaataacaagggagaagtctgcctccatgattcaatcacctcccaccaggcccctttcccgacacatggggattacagttcgagatgagatttgggtggggacacagagccaaaccataacatattctaagacgaggaaactgaccacaagaaactttctccagcagatttcacctgcawttcctacattcaactgaatcctttaaattgactgaggcacatcctgtaccaaggagagacctttgttactgcctttgatcctgagaccttctgagccaggtacttgggtgcttttcctggggaggctttgaggygtttactycacacataatgtcaaacgtgttttataatagtgggatagtcagacttgattaaatgagaattattttcaaatatgatactaagtaaggtcttgagtgtagaatcaaattstccaattatatcctaataaaaaggaagacagattcttagtggaccttttcaactatctatacagcagtttcataaaacattaggaaatttagtaaaccttattacttctggggagtcagtgagaatcagatacatttcttaaatgtttcatttcatcaagagcagagtctatgaaattaagggtaagatttgcttcaaatcttaagaagaaagcactttgatatatatcttttaaaactaaaaacaacattgatggtattctacaatacttgcattttcctctcacttatgtagttcattcctgttctcaggaaccctgcttttaagaggaaggtcttggccaggctcagtggctcacacctgtaatcccagcactttgggaggccgaggcgggcagatcacctgaggtcaggagttcaagaccagcctgaccaatatggtgaaaccccatctctactaaaaatacaaaaattagccaggcatggtggcaggtgcctgtagtcccagctactcrggaggctgagacaggagaattgcttgaacctgggaggcggaggttgcagtgagccaagatcacaccactgcactccagcctgggcaacagagtgagactccatctcaaattaagtaagtaaataaataaataaataaataaataaataaatacagtgtcctggaaagcctgactcggtagatggttaccctctgagagttggttaagtaatatcaccttagcaggtgatattacataagagaccattctggaagtataaaaagttaaagttgctggtacaaacatttccacaaggctctaagagccctcttttactgaagacaaactgtggtgtgaatcttacatcagtatccaacatcagagtaacgagaaactacctgtagatgacaaagactgaatggctgtggccaatttattataataaccagtgatgtcagaatggagaagaggggaattctctatggggtgtagtaggcaacaattccataagagtttggcaatgtttctcctgtgctgggaattatcatgtacagccagagtactggcaaatcttctggaccttcccatgaattatataatttctaaaatatttatattaataatttatattaataaatgaaattgtgtccttgaagttcatacatcaaattcctaaccacgaataggactctatttggagataagggctttgtggaggtaatgaagtttgaatgagatcgtaagggcagggtactgtgatcataagaaccccaatatgactggtgtccttataagaagagggagagacacaaggagcatgcttacaagaaaaggcaatgtgaggacatagtgagaaggtggccatctgcaaatcaaggagagagaccttacaagaaacctaccttgccagcaccgtggtcttggatttccagcccctagaactgtgagaaaataggtttatgttgttcaagccacccagacagtgttattttattatggcagccaaagagactaatacaataatatttttctgtttaaattttatctagcaatagctgaggatctttcccaatttaataatgcttgctatgcagctctcaccatagtgtcgaggtaatttaagaaatatagtgcacatcacaaaacataattatttgtagcatcactcttttcttaaggtgaaagaataaatttttatgaaatctcaaaagagatgtagacatttgattcatttttcttaatttaggatacaatcttagaaagccaaaatctaaataattgttggtggagatttgggcacttatttaggataagatcatggatacctaaaaaacagtggttggttaattcatcaaaatgacatcaaaatattttaaagtaaacttagaagtttccacaattataaatattcttagctctttccaaagctagaaaatgttttatttttagtaatcaaagatatatgaaagtaaacacagaaaaattattcaagtgggatacagaatctctatcacctattatcagaattttgattacacaaaagattaaaaaatgacttttcacattgtaggcaagtcacgcatcattaaaccaagggaacaagcacatcaaaaacagagtgaaatttgccaaaatataaaatattttagttttgttttagattaatatgttattaacaaagacaaaattcaatttctaagttttgtttttcactatactctttcatattctggaaagatctgtcacttttctaaaatacaaaactaattcttttcctcgaaagacaaaaatatacacacttgtgtttccctgactctattatccttagtagagtctcaatcacccatttgattaagcttatttcatagaaaaaactgggttaatgggggaataattaagaacggatgtcatacagtatttactgtattaccaaaggtcacaggaaacacacctggtggccgtgtcatccatcctttacatctgcttgccatggcaaaaataaatatactcattgatatagatgtatcccaagagatagtcttctggacagcatataaaaataacaagcacaagtatgtaaacttaaatttatatttagtagtcaaggactcaactgttatacattcattagaagttactttgttttctaagaattctccaattttaagggtatttaacattagtcaaggtcttaagtaacctaaggaagttagaaactaagttaaagctgtcacactgcaacacatagttactattgacagaaaaggtttatcataataataatttaatttaatgcaatttttcatattttacacattgtgcagaaataatgttagtttttatgatcgatagaccactataaattcagaaattgcagtttgactcttatcatcatgagaaaagcaaccaaaatagagtgaattgtaggtcaaattatatttagtgtggctttatcagaaaaaacatatagactttttaataaatgaaattatttatataatttgcctaataatggaattagataaacttggaatttaaaaatgcttctgaactaaaggttttataagaacatttttaatgttttccaactttattggtttataattaacataaaaaatgtatatgttgggttgatgcaaaacagcaattacttttacacaaaccaaatatttaatgtacaacttgatgttgtgacatacatatacactgtgacgtgacaatcacaaacaacttagtgtatgtatctattacataccatggttatctttgtgtgtttgtggtgaaaactcttaatatctatccacttagcaaattttaagtatacaatacactattaaagatgatatttttaatctagtgtatttaaagtattagtttatttttcttttttttgaatttggaaaaattggatttatatgtacatttatctttaaaagccaattagaatagtacctctttaattaaagagataggaacatttatatccactaactgaggtcaagacctttcacaattacagagtcacaaacgtgttagagaactcacagcctgatatcttccacttcagccacgagtcaagaatacacacaaagatgcaaaaatccaatggctgagatctcaaagagaagttcagtttcccaatgtgcataaaattctcaattgatttgagctcacaagtaaaacaaaatagacaataagaataataagccgattacgtcatcttttattcaacagacagtagacctacagagatcatcgaattggcagatcataaagccaaattcctaattgcttcctccagtggaaaataagccatcagctatgtcttactcagcaacaaaacaaaatatatagttagtaggaaacaaagttaaagaaacagagtgaacaaggttaaatatctattgccatttgataccctctctgggaggcaggaaaattgttcatgggcttaagcaattcaggaggtccatttcttcagccccacagtttacctgactctaagttgatgaactagacattttggcagataatctacctctaaacccattaacacataacattcccacaggtaaaatcacaattctcatggaaatatcaaataaacatatgtcaaatgttatttaactcatcagtttaacgaaagaaccagtaagatgttgaaatcagttctcagaaatttgttggtttttttttcaaccaagaactccccactgacaccaaccctatcaaaaattgccatttgacatttcatctggatgttttaaaggcctctcaattcactgtgtccaaaaaggaattcatgactttcttttccaaatctctttccttctcttggggtgttcactacttctggcaatgatcccactttgtgttgaattatttacaccagaaatctaagactaataaatgatactttatctcactacactttcacctgccattacatgtttattaccaaactctgttgattttactttctaaatatctcttacctgtatctgcttctaacttaaccacgttcatccataccatgacaccaccatcaccatttcatctggaccatatcacttagactaaaccattagccatatgtttttctcattggtttcactacctcaagcatcttcttatccctccagttttgtccatatatcagccagagtgatagatatgataatgtattctactattagaaatccgtaatgatttcctattgctcttgggataaaaaacaaaacactatgaagccccattgatcttaggatagggacttaaactttcttattctccaccatttttgtgatagagactcaaacactgtgatcctccctcctcttataataaagacccaaaccttataacacttcatctctcttaggataaagaccaaaatctatgataccctgctgctctcaggatagagacccaagccctctatctggagtacaaggctctcttacaatgctgctagttaccctaacttcctctcttcaatattgtcatgaaccaggattcccctcactttctggctcagccttccttaatttcttcataggtttctcaacttctcatcactgcatcttagaagtgtataatttatttatttatttatttttactttcaatatttttctcttaaatctcctactttgctgcctggttcaaacctatgattatccaagtttatctcatttttattttgtcagggccttttccttgactgttcaggcaagaccaagttatacccctctcctgatagcacttaaaaaacattgtaatcttggccaggtgtggtggctcacgcctgtaatcccagcactttgggagaccgaggcaggtgtatcacgaggtcaggagttccagaccagcctggccaatgtggtgaaaccccgcctttactaaaactatgaaaattagccaggcacggtggctcatgcctgtaatcctagctactcgggtggctgagacagaagaattgcttgaatctgggaggcagaggttgcagtgagttgagctgagatcacatcattgcactccagcctgggcgacagagcgtgactccgtctcaaaaaaaaaaaaaaaaaaattgtaatcttacattgaattttgtggttcagtttttttctctaccactgcacagttaatttcaagagggcagggccatgtctaattctacttattatattcctactgaatattatgtagttgacatatattaaataattttaatttaaataaaatgtatttattgagtgaatgtaggacttgctgtcatataacatatttctaagtctgattctatcttctactatactagataattagttccaaattttatgtatatacgttataatgtgattagactcccataaaaaagtattaaataataaagagagttaatgtgtcatatcacaagaaggccagaagtaggaaagttgtagtagtttagcctctgaatcagatggggttataaattaacttcttttactcaccagctgtgtgagcacagttatatatttacagatcactgaaacatttttttgaaattcagtctgctcaagaaaaaaaacaggaatgagaatattacctttcacacagggattctttcaaaattactgaattaatgcattcaaagaattctttcagtactgttcaagcacttcaatattaccaatgacagtttcctgcagtatcttggatattattcacgtggacctatagagtgttagccatttaaaagtcatcagctgcttttgctgtctccatgtttattgcagcatttaggactaggttcaactactcataacagaaaatgttactgtagtggcttaaacacaaataatttatcttgtgcaaaacattcaggggtgagcatttggggagaataacaccaagaagccagaccctttgtaacttcctgcagtggttttagcaccttcaggcgggaaagtcaaagaagagaggagtgacattgggagactttgatgtacgtatcactgcccagaagcaatcatttctaacagtgaaaaaggaggggaaatgaaggtttttgcctccacaatctctatagtagaagcagacaaggcaataggggaagggaaaaaagtttggtccatcatatatcctaggtgtaggtatttgagggtgatgaccataccagttaattagggggagatgagtagatcctcatctcttccaagtataggaagctaactttgccgtaattgttactaatacacccttcaaaatcaccattttgaaaggttttgtgaaatgagcattattttcttttaatacaaggtcagaccttcagaatgatgaataaactcatttgagggcaagtaccaattcagagctgctgtaaagtaggcattttcaagaagaaggaatacttctcatgtttgaactgtgtaagcaagtctttatttattttttgaatcctgaaacagcaattagaaaagagagaggaagatatttccttttctgaaggctgccaagaataaatcctattctcatttgttaaaataaaaagaggtaataagctaaagtaagaatacactaaccttattcttgaacccagccgcctctagaaaaaaacactataaaagtgaagctaagttcagtaatttttgcagtcattgcctttttgttagctctagttatctttcaagttttattgataataaaacattaattgcaaggacaacttttgaaatctattattgaatacctaggacactcatgatgtctctccacattcttgccaaggaattgctttatgaattaaaccacttggggaattaaaccactatcaattaaacatacagttgtataaggatagacatatactactttacatgcaaaaatttaggccatagcaatttagtaactaccacgttacagggactggaacttttcactcctccacttcttctatctcaccactctgttatatgaagctatgattctccattcagaatataactacattagtttttgaaataggaaaatatgaaggacagactctagaaatatcagaatcacttggacaacaaagtccaaaatatgtattatgaaagtgaattatcatgtttgactcaatatgttgctgcaaataaataaaaattatttgctcaatatagatactccttatatgcctcaatattttatatacactgactgaatatttatgactatgtatgagcagaataatgagaaaaaaacttactaaaaaatctaattattttgttccttttcttaataaatgtcccgtttcacagttataacactttctggatttttatttttattctgactttataaaataaacattatttttagaatagttttaaattaacaaaaaaacacacagagattacagaatgctccatatatgttatacatatatatatatattatatatacacacacacacatatatttaaatacgtatattatatatatattttatatatcccgtcccctcccctagaaatcactgaattgtttactggctctaaagttttgctctcattattaaatatgtaacaaatatatattatatatttatatacaatgtatataaaataaatatatatacacatgtaaaaaaatatatatatattttgcctgctccagaattccattccatccaggataccacagaactttcactaatcttgtctctttgggtgcttcttggctataacagtttcttaggattttcttatttttgatgaccttcacagttttgaggagtgctggtcagatattttgtaaaatgttcctttcttgtaatttttctgattttttaccatgattagactggacttagggcttgtggggatggactgtcacagaggtaaaatacattctcatcacagcatatcaagggtttatactattgacatgacttaaaactattgatgttaacactgatcacctggttgaggtagtatttgtcaggattctccactgtaaagttaattttttccctgtttctatattgtattttagctatatcaataagaactcatggacatttctcttgtactttgggttataatccaatcttttttatttttgctcaaattgttccagctttggtcatcggacactttaagtagctgctgtgtgcttttgatgttattgcagcttggtctgtttagcactttcttactttctaaaatgtcaagatgctccaggcttatcttgtatattaccttatgtagctccaggattaaccatttctccaaggttttgacaaactcatagtgtcatgtattcaccattacagtatcatacagaataattttacagcccgagaacagccctgtgattcacccagtcaacctttccctcccttagaaattactgattgcttactggctctaaagttttgctctttacagaatatcacataaatgaactcatgggtatgtagcttttacagactgacttccttcatttagtaatatggatttaagattcatccatgtctttgtgtatgttgatagcccatttttaaatcactgaataatatttcatcacatggatataccatggtttatttgttcattcacctattgaaaggcatcttgattgtttccaatttgggacaattataaataaagttgccacatgtataaatatgcatgctgctttttgtgtggatataaatgttcaaataagttagttaaacacctggtagtctgattgctggattatatgataatgctacatttttccttgttaagaaactgacaaattgtcttctaaagcagttgtgccattttgagttctgatcagcagtggatgaaagttcccattactccatttcattgtcaacaattattttcattatgttgttttctttttggtgagttttaaaatggctttgtatattttatatataagtaatttattagatatgtgttttgcaaatatctccttttagtctgtggattgtctttttattctttgaacaatttattttataaaacataagtttttaattttgataaagtccaacacatctatttgtttaattgattgtgctattggtgttatgtttaaaaactcatcaccaaatcctgggtcagacagattttctattatgtttttgtctagaaatttcatcatttgtattttacatacatttgtgatccattttgatttaattttgtgtaaggtataaggtctttttctaagtttatttatttatttatttttgtatgtggatgttcaattaatccagaatcatttgttgaaaaaactattctctttttctttcaacctttttgacccttttgtcaaagattaaatgatggtatttctgtacaataatcatatgatgtggctgtgtcccaacccaaatctcatcttgaattgtagttcccatgattcccacgtgttgtgggagggaccctgtgaaagataattgaatcatgggtgaggttttccctatactgtcctgtggtagtgaataagtctcatgagatctgatggttttataaggggcacctctttcactcggttcccattttctcttttgctgccgccatgtgggacatgcctttttccttccaccaggattgtgggcctccccagccacgtggaactgtgagtccattgaacatctttttctttgtagattgcccagtttctatcaggagcacaaaataaactaataccgatgatatctgtcttttctgttctgttccattgatctaagtgtttattgattggctaatatcatgctatcttgattactgtagctttgcagtaaatcatgaaggctaataggacaagtcttttgactttcttcttattcttttttactactgtatttgtttttccaggtcttgtgccatttgtatgaaatttagaatcagtttgtttccatctacaaaatagcttgccacgattttctttttgtggttacattgaatctacagattaggttgaaggaaattgacatctcaacaatgttatgtcttctaatgcataaacatgaaatattgctccatttattgagatctttgattttttcatcaatgttttatagttttcaacatacaaatcctgtgcatattttgttagatttatatttgagtatatcatttattggatgctattgtaaattataaggttttttttacattttaattccaaatctttgtctttcatgtatgagaaagccatggactttttatattgccctgatatcctgtaaccttgctgtattcacttattattccacctaagcggatctcagctgcatctgctggatgaggtggtgctttatcctataacttctattctctgatgcatccaataaaattcattgattttcactttgtcctgcttttccttgtaagaacaggaataatgaagtccaagctttcacacataggagataaaactgaaagtccacacattctgattttaaaaaatcttctattcttttgttttgctattcatatgtgttttttaaatgtttatgcttgaggtttgaattgtttatgtaatgtagaatccacagataaacacaattagcaaatgtaagctataattcttacagttttaaaggtacctttgtatgtaccccacaaaaaatagatgtcaacaatttggaggctactttttatttaagtaattttacacctgctttctcttttttttaatgaaacccagttgcagttctttgaacaccaggaaaaacttcctagcaacctctgatgtattcctgcatctagagtagaaacacagcacacagcacagtagagaattgaaaaatttgagaaaaagagtcagttgttggccacattgactaagactcaggcacgcacatacacataccaaagtgattagcaccttagttgagctcaaataaggaggaaaaaaaccagcattacaagagtgagacagtggcaggttactactagccctgcctgtggtatttctcttccatttgaccagaaatggcaaattctgttgaaaagaatggcccattttcaggcaaagctttaggaagcacatgatttccacatagaatctggcctttgtcagacatggtatgggactgtaaaaatgacttattccaagatgagaacacatggggtagagctttaaaacctgcaagccatgcgttgttctcttattgaagttttgttaaagctgttccagacatttgctgcctttgcttccatttttggacttgagagagaagaggcatcaagacgtctgcaggggggacatgaataagtgtgtgtgcacatgcgcacctgtgtggatatgtcaaaataataaagtttaataattgatttctataattattaaatatagctttactaattgatagctataattattaaacatagctataattattaaatattaattattttatatgtttagaaaaaatcctatacctttgataatattcatgtgtgcaaaatatattcttctgtcctggtaactgctctgttcataatcatctttttttggacaaacaaagaaaacatatagacaaacaggattaatataaaatttaacaattatatagcaatacagtggctaactatagctactctaattaattacctgttctagagtgattggactatcgcaggtataaaccctagcagggataaaatctttttatttatatgctatataaataaagtatgttctaaaacacttgcatgatttattccacgaatactgcatggatttcgttgcacgtgagaatttctctgcctgttcttcctattaaccactaaatgttatgtcatgctggggatgtgagccctgaagcagtgacaggaaatatctgcaaaatggcaaatgcctcccattactgagagtgctgattacaaagctacaattacatgtggattattcatgtttgcagcaatataatgaactggtttatagtttttcaagaagaaagcatctgtagtatagtaaaaattactctgaatcttggatcaaagaatccgggttccaatccagcctttgttaccagtagctgtgttagttaactattgctgtgtaacaaattatcccaagacttagtggcttaaaacagtaagtatttgttatctcttacagatttgatgggtcaagcatttgggaatggctaaactggacggttctggcttgggatctttcatgaggttacagtgatgatgccagtcagggcagcagccacctgtaggtatgacagtggctgcagcatcggcatccgaggtatcttatttatgtggtattggcagaagatatccactcctcactggcagcttgactggcctcactttttagcagctgactttccccagaatgggagatacaagaaagagagggtgagaaggaaaccataatgcctttttgacctggtcttagacgtcacaagtcaccatttatacacattcagtttattggaagtgagtcactaagggtggtcatacttcagagcaagaaaactagcctcccttgtatgaagtgaggaatgatataaaaaaaagggtgtattttcataccaccatggtggccatatgagcttcagtagttaaacctcgctgaacatcagtcttctccacaaatgaaaataacaatatctacctcaaagaattattggggctgttcagtaagatgatgcatctgacatattttgtaaaatgtaagctattgcatcagtgtaaagttgattgaatgtaatgtcagtgatgttttgtcatagacatcaccaatgcatgttgaggaaatcttgtttagtgacttccaagttaggcagacactggtactgtgcaccctcctctcaaaaaagaagcatgcaaatctttgactgttaaagtatatagcattcaaagattttgttgtaatcattgagaataataatttaattatttatatataattaattattgtttaattattaattaaattattatttaattatatataaatatataattatttaattattatataatgaatcaggtgcagtggttcacgcctgtaatcctaatcccagcactttgggaggccgaggctggtggatctcctgacgtcaggagttcgagaccagcctggccaacatggtaaaaccccgtttctactaaaaatataaaaattagccaagcatggtggtgcatgcctgtaatcccagcaactcaggaggctgagacaggagaatcgcttgaaacccaggaagcggaggttgcagtgagctgacattgcaccactacactccagtctgggcaacaaagcaagactccatctcataaataataataataatttgttaatgaaaaatgttaatttccaaagaatgatagagtttaaatatcagaattatttatcttattatttttggtggattgcctaaatatacagactttgtttttcgtgtttttgtttgttttcccatatgacaagaggctggagactggcaggcaggcagcatgagcttctgcagcagcgcagttctgtgagccatggcccctctgtttctgggtaatcaccctcgtccttggtaccttctgcctgctccccttgcagcactgatccttcattccaggcagatggaataagatcaaagcacaaaaaaaaaagtttgctgaatatgccctgttttattttaatttcttattttcaaataaatttagacttttggaaaaactgtaaagatagtagaaagtttttgtatacttttcatccagattcacttaaggataacgtcttttataatcatggtatatttattgaaatcagaaaaccaacattcactatgagccaattggtattagttacgctataactaattattattaactaatagtatcattatttacttatccacaatacaatgatgtaataacaaaatgtagtatataatattaaatacagcaatgtaggatagtaatgatagtactactgctagttttagttaataatattaactaatttacaggccttattaaaatattttcagttttaccactaatgtctttcttctggttccacgattcacaatgcatttatgtgtcatgtcaccactgttgtctgcaatctgtgccagtccctcactcttttcttgtcttttgcgaacttgaaactcatggagaacgcttggtctgttattgtgtatagaatgcccctcagtttgggttagtctgatgttttcacatgactaaattgaggttatgcagtttttcaaaactgcggcagatgtgatgatactgtgcttttccactatatgatagcatgtgatgtatgagatgtaaacacggatcattgttttcttttcctttttttttttaagacggagtctcgctctgtccccaggccagagttcagtggcatgatctcggctcactttaacctctacctcccaggttcaagcgattctcctgcctcagccttccaagtagctgggattacaagcatgcgccaccacccccagctaatttttgcatttttagtaggacgagatttcaccacgttggccagaatggtctggatctctcaacctcgtgatccacccacctcggccttccaaagtgctgggattataggcatgagccaccatgctcagtggatcattttttttttatgttttgtttgtttgtttgttttgatttctatgttgtctgtcagatgtcttttaagtgatttttttttaaatttataacttgtaagtgtcttctgggaagatatttttaggctatggaaatactctgtttttcatcatacacttgcccactaattttagcatcaataatggcttttgcctgcagtgactacttatgtagtgtttaatgtgatgatttctgtagggatatataaatgagccaatgagaaaccacagacatcacatttctagcttaattctgaaaggtaaacgtctcattggcaaattttaaaaagttaagacaatttggtttcatcaggagacccaaagaaaaaatgagtagtttgaatttctggtcataaggatagtattcttgatcttcttaatatggaagcaactaaatatatttacaacaggaagaactagatatacttgcaaaattcaaagagaaaaccaaagcaatacagccaagttctatttgcaggtcgagatcttccaaagaaatggcagtattgtgatagttatgtacttttaaaactggaaagagatgggaaaggtacaagtggatgttcatcatggcgtagacatcaatacatgatcagtcaagttttacttcttgttttaatgagaagaaaaagctgtgattctttatttattcaaaatcaccatcacttttttctttaaaatagtcagactactagggcctctgatacttattggaagataaagttaaggagagaaaaggggtgtataaagtaaaaatatatggcagctgtccaacaaagtcaataatccactttagggaccccaaaatagattttctggagtgtctgtctgtgcacaagtttgtcagcatttgagagaaatgactgagcagccacaacaaagagtgtttaaacaaaccaatctggatgtcaaaaggttatgtgccgcagagggctgctggtgttaattctatatggattaacaccacagccgtttcttaaaatagaaaaacttgaaagaagtgagtgagctcagagaccttttttttttgtaggaagtctagatgagacatttatttttttctttgaactggtgaagttctctctactcagtgcgactggtgaggttgcatgaaaagtctgtgaatcaatcacaggacccagttctgccctgagacctcaaggagagaggaggctatgctggaccccgtactgtagaggatccccactcctaccctcttgtggacaatgcacccctcggcatggggcaagaagtccaagaacgccataagccaagggaacgtacacacaattagcctgtgtctccttctgcacaatgctttctgcggctcttccttgcagagtgtggagctcatttgcaagagcagatctcttgcttggattcatgttcttgtggtcacaccacaccatccccagtatgggcctctctccagcaaggggatgaggatgttgtttgatcgtggggctaatgtacatgaccactgggaccctccaaggtgtggcaggctaggcaggaatagcagagaattcactacaggggtgtgtgtgtgtgtgtgtgtgtgtttgtgtgtgtgtgtaggtaaggaatatagagcaggaggctttcacaatattccagatggaagacagtgaaatccgccaagcctaaattcaaatcataccaaaaggtataaggagttaagagaagagaataggatataccttacttgtttaacaaattgtttccttttttatataaagtaattttaggtggtaaaatatacagaaaatataaatatatacaaaacctacataaaatttaccattttcatcatttttcagtgtgaaattcagtggctttaagttcattcatgatgttgtacaaccatcggtactatatacagaacattttcataattttaaacgaaacatttgttcctattaaacgctaacttcccaatcccctgtaccctcaggccttggtaaccattattcttccttctgctttcctgcatttgcctattctagatcctgaatatagtggacacatgcagtgttttccctttatgtctagcttctttcctgtagcacagtgttatcaagtttcatccatgttgttgcgtgtatcagtacttcattcacataattttatagataaataatatttcattgcatgtgtgtaccgcatattgcttatccattcattagttgctgggcacttgacttgcttccatgttttaactacagtgaatatgctgctatgaacattgttgtacaagtgtctgcttgagtccctgttttcaattttttggggtatataattaagagtggaattgctggatcagacagaaactgtatgtttaacattttgaagaactgacaagttatcgtttccttggctttcccttatactatttgcacatgtagcatgcagatctccactgtagccctgggtcctgcaaatattattagggacaggacgtgacagcaaccttatggatctatacatgtagacagtaaatcaatccttgtaaatgttagtctttcactttttttcacttttgctttccatattatataaatgagaaatctgggtttccatcagtgttcaaacttggaaacttttgtgtcatattaaaaaaaaaatccaaatcaagctgttttgtggtatttcagatctgactgaaaccaggaagtaatagaaatataaaaagaaaacttgatcttctgaggttttctttaccaaagtaactgggataaaaattaagcctttaaaatttttgaggttcatatatcaatgccactgatttctaaaaaatattgtatgactagcttcttttggaaggtaaaaaaactcagttctcctacaagactttgtagaaattctttgtcttaaatcatatagcttaaaaaatgagccttttaaaactgtgaaggatatcagaaagaaatgtgaagaaagaagaaaagcacaaattaaaagaacgaacaagagctacgttagcagtgagacccaatttaaagagtttgggtccagccagagcttttcaaatcttttgaagcttatacagtgttctgatccctaacaacccatattcttgaaaaattaaccagaaaactagcatgagctaaatgtctttatgtttgaattagagaacagggaaaggtcttgctgcctttagggaaagcttttaatcagaatgtctcttcatcctggcttttgacctttcctaacattcaattgttttttcacactgctcttgaaagagcctgcggctctaagaaagaaggatggatatcttccccttgcttagcacggtttatgtcaagattttgcccttgtaaaagcacctaaatgtgctggtgacagacagagagggatgatcattcaaaagtagtctctgcttttgttaaacttttatttcaaaacaatggagagcacatcccatcactgctacgaaaagttctaacttccaattcataggtcatttttttgaaattgtattttctgattaaaaacacatatttctccaactagtatccatccttatttctagaggtatcaccgtgcatttcgcaccccctaaataaccttcttgccccgtaaaaaatattttgtaagtattcgtatgtacccacagtccataattaggacatctcacttctctttgttaaaaattccttatgtttacagcttttcaaagggctttgcattcactaactaagtagtcggaaacttttgagacagctttgcagaacaagacacaacaactacatgttgagtaacttgctcacggttacatgatagttatgtaagatgcttggtgataggactgggcgctaacatgtttttcccaagaaaaataaacctccattgcatctagtccacactaggacgatgttttgggcatatgtttttccaagcatctggtagggacagatcaggtctaagggatttctgaaaggtttaaattaaataggatttccctttaaaattttgatagagaaatttagaaaaaaaaggaatcaaatgctaattcagaaggtattgagaacaggaaaaatattagcttatcagggaacttcttaaggtcagagtttcactatcacattctagcttcttcagtgcctcctcattttggaaagtgttcaggacttttaggtgcagttctggacacctcacatgtctgaacatatccagtggtctttcttaaagattataaggacttagcagcaaattagtctgtttttcacatggtcggagatggctgaggcttaagaatgctgcacagcatcctgaggtgattattagtactcagaaggcctccccacctctcttgcacctgtgatcctcatcttgcccttttccaaatatcgagcagccaccataatatgtgtgtgtgtgattaatcaattattactaaaggatcagtaatccttaacctctgagattctcactggatattaaggatcttaaaaataggagaataatcaatttaaacctttaagctgttttgcttctgatactattccatgtcttagcattcaatgtatttttattggtggatccatatgacaaagtgaaaaggaggagggttttggaaaaagagatacagaagttcacattttagctacccgataactgtaaaaacaagggcaattctgtattgggcttacatttatcttttcagtggatctatttaatwgaaatagaaataaaacacatatcaataattgcaccaagatactgaaggtagtttttattgaaaacttgatcactaaggaattgacagaattgagaagtgagaaaatttcaaagatacacatgcctgaaagcagaaatcatatcttatatgtcaaacatgaaaatcaaagtcagctgcttgaaatgtgggcctaataaatcttgaatctctgcaactgtagggaatagttattgttttctaatctagcacacattttagtaaacttttctgtccttaatgttaaacttcatatttcctacacatcttttttaatgttaattattttaatatgcatgcatatatttaccacttattacatgggaagaaacaattcttaagtctgagaaggttggtaatcatttacatttctgacacaaaactgaaggcatggttgagaattagaataattaaaatagcactgggggacaacctgaaaactgtgactccattctgatagaaggagtcattgtccttgaacaatttgcaaatatgttcccttcttttcccaaatatgttcccttcttttcccataacaggcttccatgctttatgcaactaatgcgttatgaattgcagctctgtttcttacagagaagtgaatttacaaaagacatacctttcacatcatgttcacctttttcacctcaatgacaccctgctcccttctcttaccttccctgacaccacacagttcaccatcagctcttcctccttctcaacaccctaacttctaacctgcaactgaagctcacagttgtgcttagtatctgcgtgacagttcccttcacttgacaagttttaaaagtcaactttctttgtcttacagtttattgtcttcagtcttttatttcccttaccttttaataaaaggattcagtattccatttctattaatcttttattaaagtttattagaaatagaatgctgaatagaaaataggaagtttagctgtagttaagattgtgattattcattatactgatatttttcttatattgtttttgaactgatttatgggtagttagctccaaaactgaaggaatactatgatattttcaacactattaccagcactatgtcaggtattaagtttaatccatgagcagagtgcaatttcaagatcatgaattttcacaaacttcaatgttactactgtgtttatgctgaataaatggtttctttggcacctctttcacacacacacacgcacacatctatacatggtaacataggctaaagcaattagagaagttcaggtatttcaatgactgaatcacaaaaatatgttattgatctcatttgttaatcaatgaatggttaataagaagattaagaagacaaattacaaggtcacagcccattcagctgaagcatgttgttatggccagaggctcatgagaggaaaaggtgtggctaagaacagaagatccgttaagctccaagcctgttcaattatttaagtcactgagacaaagtagatgtggagtgtgagacgccagtgtagagccttcaactgattttccttggggaggttgacctgacttaatagtgtgggaaatcaggtgaattttggctgtgactagatttgaccaagatggagttttccatgaaaatgcaaaccaatctttagaatttgaattccataaagcaaaaaattcttacataaatgcttataattttaccactctaccactgtgggatgcatgccacgagattttgtgagtagttctaaaaagtatgtcttcttggacaacatccaaagtagaccacatgcacactgaaacaagccttacacaatagcttttctatatatgtatctatatctacatctatatttatatctgtatctagctaaaagaaaagctccacatactgatagaattatataaaagcaaatactaacgtttgggaatttcgattataatacacttaattgaaaacaaaacaaaaatattttttaaagtattaagcaagcatagagagacattttggtgcttacaaggatttctgggaatacaagcaattattttttgtcagggaccatatatttaggtacagatcattaacaatgctttctttaatatttatttagtgaattgtacatgttaactctaagggcaattaaaacccataattataatatgagaaactttttctccacttagtattttttattataaatatggctagcattgaatcattggctataaccatgtaattttaatgcttgggaaacatctgttagaaaaactttccctatagaagacatttatcaatgtcctgccttatctctggttatctttggtttattacattttatgataaccataaaactgaaaccatcctcatttacatttttcctcttctaaatttggggaaattatattttaagtgtttatcattatctcattatataatctacagaaataataaacagcagcatacctgattttaaaatgagacttttgaatttctacaataaatagaatataacgaactctgcttctttgggtatatcacgtcaaatatacattaatgagcagatagctttaacatgtttatcatgttataatctgattgttgtctttactaatcaagatacctaatttaactgaagtatcaagtgatctcaaaacctcagtagcatctgataaaggttgctgtctcacctgtgccacatggccattgccatttgactgctgcttcacccacatcacctgcactcccaaactcagcctggctggatatctttttacaagatacctgataatgaaggagagaaggaacatggtgaacactatgcagtctcagaagatctgcttggaagagacatgttacttctgctgtcatttccttggccagagcaagtgaaatgctgaacctgatcagtggcttattgtttgaacagtaatacaacctactgttctatcatagaatgatattggagtcatatatttcaattagccattatcaatgtctctcataattttctttacacattttctcagaatctagagtaaaatttaaaaaaggaaagacagataaatgctctcatctccaaattcagtgtcctaaattccacttactttaatcagtataaaaatcaggtagctcagattttaatggactagtcacttttgtctctttttttttgctatcagcgtttatattgattatttggaagaaaaaagagccccctcaaccttccagagcggacacacacacgtacacacacacatcggcaacattagagaggttgacctgaaagtgttttaaaaactatgacacagttaaactatgatttcaaagtttttccaagcaagttatatgtcagaatatgagtaggggaaaactattgaactgccacaattctgctggtggtttcattggcaattccaattatgttctgatcatagtgtcatcagagcaattagttcatcccaaacttgttttgtattgccactccacagggaaaatagtaaatctgtcctactgactgcagttctctaaaatgtccttaaagtttagttatttcaaacttagtggaagaaatatgttgttggtagtggtcatccttgctagtactctttaatcattacctgccaggaaacactttttatttaccagtgcatgagagtttaggtgagaattattctactaccgaaagctcaagatgtatttgtgctatagttataaatatagattttttttttgtaattctaacttttcaggtacttttctctttagctgttttattttagtatatgtattttttccattttttatggaattgtaaggcatatttggtggttctagtttacaactataacatcatttccagagtcatcaattcctttgtcaggacatgacattatgtttttccattttttagacttcctaaaatgtcttgataaccaaaacacagagggttatcattatacagttatgtatgatacggtttcctctatataatgtgtcacatagagtattttatttccagccaaagatcattattttttaaagaaactcaggaacaagaaataaggatgcactcacacaaatagacagtagtgaattcagaatgcatagcagagtgtgcaaagtaaagcaaatgcatccatgcccaattacctaatttgtaattgcagctattcattgcacttgattctttccttcaactccttcctctccttccctccccggagctcctccttcccagcgtttgtatggcagcttcgtaataaacccagaacacttagcaatttctgctccgatttgctctagcttcaaaggtctatggtcatgattacatgcaataacgatacattcaatgtgaaactacaatctgtgtaactttgtatttctctttgaaggtttagatacgattgactgtgtcaaccataagcagaataataattcctgtgctcagagacaagtcagagagagagagagagagattgacaaacaaacaaacaaacaaacaaacaaacaaaaaacagattttaagaactgagccctaattcatttttttttcttttttattgtggcaaaatacacatgacatttactatcttaaccatttttaaatgaacagtttagtgatattaaatacatatattacattgtgtagacatcaccatcctccatcttcagggttctttccacctttcaaaactgaaattctacccattaaacaattcctcattcccccccttcccccagctcggctgctggcaaacagttctacttattgtctgtatgattttgatcactgtaagtacctcatagaagtgtaatcatacagaatttacctttttgtgatgggcttatttcacttagcatcctaaaggtttgtccatgttgtagtctatgtcagacttggcttcccttttaaggctgaatgatattccattgtatatataaatcacattatatatgttatattctaagcattttatatttttaggccttacatttgggtctttgattcatattcagttaatttttatatggaggttcatataaggttcaacttcattccgttgcatgtggagattcagttttctcagcatctgttgttaaaaatagtgtctttttcccattaaatgatcttgccacccttgtcaaaaataatttggccatgtaagtattttattctattggccaacatgtttgttttacgccagctgatataaccatatgtaattattcacttattagttctgaattcatttattagtttcatatgggattttttggtggaatcataagagttgtctacatatatgattatatcatctatggacagagataagtttacttcttcctttattccaacatatgttctctctttttcttgcctaattgctctagctaggatttccagtactacgttaaatagaagtgaggaaagcagacacccttgctttgttcctgatctgacaggaaaaactttttaaaaaattgtgatgaggtagtttccttctatcctagtatactgagtattgttttaattatgaaaggttattgaattttctcaagtgcttttactgcatcaataaaagatgattacatgtcttttttcttcattagtgtggtgtattccattgttaatgtggtatattccactgtttaatttttgtgtgttgaaccatctttgtattccaggcataaatcctactttgattttcgtatgttgaaccatctttgtattccaggcataaatcctacttagaaatggtgtataattcctttaatatgttgcaaaattcagtttgctagtacttttttgaagattgttcccattaatgttcatacggaatattgatctttagttttctattttttgtgatgtctttgtctgacttgggtatcaaggtagttctggcctcatagaatgtgttaggaagtgttccctcttctttgatattttggaaattattgaaaattggggtgagcccttctttaaatgtttggtagaattcagcaaaaaagccatcaggccaaggacttttgtttgtcaggatatttttgattagtaatctatctcctgactcttaaaatgtctattacaattttctatttgtttgtggtttagatttagtaggctttgcgtttctagaaatttgtccacttcatccaggttattcaatttgttggcatatcattactttcgtaatactctctgctgatctttgtatttatgtagacttggaagtaatgttcctatgttccttttttttttttttattttggtaacttgagtctttcttctttctttctagctaaaggttttctaaatttgttactattttgaagaaccaacttttggtttcatttattttccctattattttacattctctattttatctcagctgtaatatttattatttcattttttttgctagtttcgggttcagtatattcttatttttttagttccttaagttgtaaagttaggttgatgatttaagatctttcttgttttttgtaatgtatgcatctaaattttctaacagtgctttcattatgtcccatatgttttgacatattgtttgttcattttcgtttatctccaagtattttctaatttctcatgtaatttattatttgatccattggtaagagtatgttgtttaatttccacaaatttgtaaaagttctcgtttttcttctgttactgatttcttactttatcccattttgatcagaaaaatgttttgtatgatattttttaccgtaagttttttgagacttaatttgtgacctaatatatgttctatccaggaaaatgttccatgtgtacttaaaataatgtgtatgccatagaaactgggtagagtgttccgtatctgtccattagacctagtcggtgtattgtgccattcaagttctctgttgccttacttatattctgtctcattgttctattcattattgagagtggggtatgataactacaacaattattatagaactgtatgtttctgttttcaattctgtcactttttgcttcatatattttatggtctgttattagatgcataaatatttataatttttatatcttcttgctacattaaaccttttaataatatataatgtccttcttgtatgttttaaaatctactttgtctgatattagtatagccactcttgctcttcttcacttactatttggacaaaatatattttttcatcctttaactttcagtgtatctgtgtctttgggtctaaagtgagtctattgtagactgggcctacatcattttttaaaatccattttactaacctctgtcttctgattggagagcttaatccatttacacttaaaatcattgctgataagcaagcaattttgctatttgttttttatatgccttatagctttctcatacctcattttctacatttctgtgttttgtgtttagttcatctagttgatttttcagttaaatattaaaagtctttttttctgctattttctttcttctatattctttgttgttaccatggtgattatattcaacatgctaaagttataacattctaatttgaatttgtgccaacttaattttaataatacactcaaatattttttacagctctgtccccacctctttcagctgttcatgctataaaattatatcttatacatttcatgttcgaaaacataaactaataattctttgatgcattcatctctcaaattatgtagaaaacaaaatgtggaattgcaaaccaaaattacaataccaacttttagcataataattatcttaatgttttagtgtcttaaatgaagtagaaaacaaaatgaagttatacagcgtgttacaataatactagcttttaaaattgcctatttttaattcagatttaatttttgtatagcttttagttattgtctagggtcctttaatttcatcccaaataactcccctgagcatttcttgcagggaaggtctagaggtaataaactcccccagcttttgtttacctggaatgccttaatttctccctcattttagataacagttttgctgaatctagtattgttggttgacagtattttacacttagtattttgtatgccttctgattttcacttgaaaactgagcatttgaatctaataatatgttaactctgataaccggattctctttctttctgagggtttgctgttttgttcttgacttttttttattgttgcagctgtctctgtgccaagtattagcatgaggtgtaaacttattctctcctcaggtttttttctgaacttgtatcttcccactgtgtctacatggtgacttcctaatttcacccatatatacagttgcttgtgaatgtctttatcttcaatgtcagccgtccaaaagagtaaaaagagaaaaacaaagggagaaaaaatgaggcaccaccctctttacattccctgggaaccacctcagccaggggagaggggctgacaataattgaggaggagcataacaatggccactgtttctttgtctgcacctctgggatcagaagcagtgatcagtgatcagagcacgggtctctgttatctggcaggcagggttgtttgttgcccaccctagtttctgcaagctgtgtggtagctgctccaggcaccgctgcctgccacagagttgagaggtggggaatgaataggtgctattgtgctaatagctaaaattgaccacaattaaccacaactgacagtctaagccatctcctgggagtttgaagtgcaagtctttccctggaacttaatttcaatagtttccagaattccaaaatagtaacatcagacagattctgtcagggcattatttttttctatgtagggatacatatttctagtgctacctactccaccatctttctagaatattctcctccccaataatttatatcatcatttctggggttgtaagtcaacaatctgtattttaacaatttctctaggtgtctctttgcctgctttaagttttcaatccagttagccctctctatcctcaatataaaacaaaagcaccatgaaaacatttggctctaagtgtggttgccatttaatttatgttccaaaccagaaaaaaaaaaattgagagtaaaagaacgtgctattaataattcatctgtaataatatatatgaacctggactgtctgaaacagttttttgagagacacttagaaaaaattatgctttggaaattttttatggggtgtcattaatttgtttttgtccaatttttgcaacaaaattttgacttctatagtgaggtgacattcataaatctgagtattcatatctaaaaacccaaaagcatttttttctaaggatgtcatgtagatcatataaaataactatagaaatattgaatccataatatgtcatatgagttgcagccattttaatattttgtccatttttatatattctatgcatataatatatggtagttttctgatagtaatttccaattcctctcccaaaatggactggacagatttcttagtgagggaagactgtttttatatcattcaaattttatcagtccttttctgtgggtcccctgctgttcttattccatagcatcttatgtaggattgatctcttccttgtgttagagtcaatattattattttcagaagtcttggtttttccattggcaaatgttcaaataaaactttataaccaaatctttataatgctgttgccaactttgtgtctttaaataaagtccaattgccatagggcaattgtgcagtgggatggatatgtgaatctgtgtgaaaaatgatattttaaatgctttgtggggaagagtaaccagtctggattgaattgaatgctaaattggctttacatttggaaaaaatttagatgttatagtagttcttatataagaacattaaacatctcactctaaatgaagtacctcaggtgatactgtgatagctataattgtttatgacggaaatattcactcttagaagacttgggtattgacaagaacttggaaaaggatcaagcagcaacatatatgaaactgtgcttcagcaggggaaatacagttatgttcctgggtcactggactcttgttatggactgaacaatccaagctatataaagagacataataactatgatcagaactttgtgaaatatgaccgttctatttgaattcaggttctaagcagtattccccaaagagatctgatattgaatcaatgttgtagctaccagccttgaagttacctgaactttggtattctattattcccttagcttgtagaaactgactatggtgaattcttaccccaaatgtatttttccctagtagatgaactataatctttcttattcatagtctatgattggtgcatcttctctagctcccttttttagatgtgctgaggaagtccgctgtggtcctaaagctgcacctgtgtggctgttgtctaatgtcccgttttggtgctcaatgtcatgagtactaagatgattctgagtaagagtcctaattaatgccaccaaaatttggcgaacccttgtcttttggggaagaggggcagaattcttcacgatatgcctcaaacctggcttcttcacttctgtgtacgagataatttcaaactgcttttctcacttttaaattttattcatagatgtaaaattttggcattttggctaatttaatttcaaatttgtatttgcttgttcctgctttgatgcgctacttatgttgtgtttgaaacatagtagaaaagaggctgcgtcggacaagtatgagaagacatgcttacagtcacataaaaggagaataaaaatatgtgtgtgactgtagaccgtacctccatgaacattacaaatttctgactgccatctagaacacgtgctttatcaacatgatatcaatgatgtggatattttacttactttctattttgttatacatgtttggtttagatgtgacctttgaccatttctgtataattttaataaaatagatttaactacacaaaaatcaccctaaaagtaattttccatgatgcattttaaaggtcatgttttccctgatgacagcatgtttttgtagttagaccttgggaaagacaacaaggagatctgagagctaatgcaaaattatctttactagctggatctccttggactggtcatttatcctctgaatcctaatttgccccttagcactcacaaatgtcatctccccaaagccatagctgagcagaaagtggagcttagcattttttattctgatagaagagactgtgtccatgcaattatgacagtaaaaataaatgagcatagcttcaaacatttctttaatagaaacttagcctttgggtttaaggttatataaagtgaaaggaatttgggtaattaatatgaagtcaaacattaaaagattcctcaagtaatccaaaggtatcaaatgttcaatgacataaaatacctctctagtccttatgatgagaagagaaggtcctgatgagtggctaagtagtgatgaaagtctaaggctaaatttctatgaagaaatattgtaataaaatttttgaaagatactcagagatatttcttgagatcattatcatgtattctgtacacaaatgtattctttccattttattttcagtgattttccatgtacagctataactttagaaaggctgattgttattctttggcttttctccctcaattaaatcatgtttttttggtggaaagagagatttaaaataaaatggaagcaagtggtattaattcagagttactaaaactgaaaattagggaaatgtagaaaatataaactaatatcaagctaattcttttctgtatcagtgttagaccttttatgggtgaatgaggttaaatgtgtgttagtataaaggatgtaaaggagtaagcaaagacactaagaccagagcatgactttatatctatatcagcttgagtctatttatagtagaatcactagaaagtggtgaccacacagagttgcatttttttcttttgatatgcatacattttccctgaaagaaaaaaggaaggaaggaaggaaggaaggaaggaaggaaggaaggaaggaaggaaggaaggaaagatggaaggaaggaaggaaggaatgaaggaaggaaggaaggaaggaaagaaggaaggaaagattgaggtaaggaagaaaggaaggaagggagggagaaagggaagaaggaagaaagaaggaaggaaggaaggaaagaaggaaggaaagatggaaggaaggaaggaaggaatgaaggaaggaaggaaggaaggaaagaaggaaggaatgaaggaaggaaggaaggaaggaaagatggaaggaaggaaggagggagcaaggaaggagggagggaggaagggagggagggaagaaggagggagggaggaaggagggagggaggaaggaagaatattttttaaaaagaaactctttgatgattcaacatcatggagaagttattattatattgagcttgacctggatctgtaactcttgacatttagctcttgaaaatacatctgttttcttggctgatagtcttaaaagacagaatccaacataataagcctgcacatgtatccccatatctaaaatgaatgttgaaattataaaataaaatacaatatatgttcacaaatattaaaaaaatgtgcagagatatgggaatacatatgtgtcttatgtgtgcttatttctatgaagtcgttagatgtcaaagctctttctgcatgcatccttgcttagacgttttgtctgaaattctgttcacattgacatacgtgcattaaactaatatgagaatgtatgcattaaactagcttgaatgatgtccacattctcagttttttcatcataactttttctttccagagtgcatgatgccgcagaaaagaaaagctaactgtgaaactcaaagaaagtctttgttagggcctgagtattttttttttaatctctatgactttcacattcttagcttcagtaatccttgaagagaacagagtcaaaccttgtattttaattaggatctttcagtgtttgtggccttgaggagcgagagcaagaaagacattctatgggtgtgcgtgaaagagaggaccaaggttgttttctttgtgactagagattatattgtgtaagagcagatgacaaccttgagattcgatttgtgatatgaaaccaaatgcactaaaaggaaagcgtaccagtttggattagatacattaaatcagtatgtcatgtaaatcagtgactattaaaagagaatatataggagaaaaaggtattagaagttgcattttttaaccaattgcaacgtttgcaaatgggcttgtcacataccatcatgtaagtactagtgaagtctaaggtataagcaagtatttttcatttttaaggatcattgcaaagatagagaatttgacaataaatgaactgactggccttctacaagtatttacttacaaccacaattgtaatttttccatggccaagctatgaattattaaaagaatattgacattttgctatatttttaaattatctttaaatcatttcaaatagtgaaatagtattatactaattaaactttattaagtacattttcaagctcagctaagttttttaatcaatgtttatttcagttaggggatagttttgttttttttcttctttgaaataatatctttgaaaccaatgtccacatttctttacagataaaagagttctgtttatgaaataagaataaacagcctgtaattttaatatcaccaaaactattttaatctctttttggatatgtacttcaacttaaactacatatatagctatagatatatagatatgtctatatctagatgtagacacatcccccaaaacctatagaaatgtatttctcaaatgtgtaaagtatagtgaaactgccagaccacaagcgatgttttgtatttatagatctacttgcaatttggggtgtgccaaatccccacaccttgttgtcaatattagtttaacaaaactaaaaggaaatttaaaatattaagatcatcctctttaggatctacttggagcgctgaaaaaggtgtgaaaatactgatctcggacttcttgtgagtttgatgtgttttacatttgtaatgctattctcttcactgcattcatgcgtgtgcttgaagcttgctgccttgtaggagacaatgcaacaactcttaccaatgccacttttataagattttgcctgcagtgtgtcaatgtgactcttcagtacgctacttaagggagtgcaggcaagatgacctaccctgagtcatccaaagaatatttctctagttcctgttggtcctgtgaattcctaatgtctttataataaatggccacctaaaaattaatgtaactgggttgattgtgttgcatgacattaagtaaacctaactgccgcaacagggtgcagtctgcatcatagcaaatacgttacgggagagaggggcacgtcctccctcagcgcccacaacagggatcattaaccaaggctgacacaattctccagtgagaacagatgtaaccttggaatctttctccacacagtgctccaggaagcgattcgacatgagtctgtactggcataggaaaataaaactggcatggctgccacatagatcctattttcttttgcctcttaccaagagttattttaaaaatgaaactattgtcggccaggcgtggtgactcacgcctgtaatcccagcactttgagaggccaaggcaggcagatcacgaggtcaggagatcgagaccatcctggctaacacagtgaaaccccgtctctagtaaaaatacaaaaaaattagctgggcgtggtggcgggcacctgtagtcccagctacttgggaggctgaggcaggagaatggcgtgaacctgggaggtggaggttgcaatgagcagatatcatgccactctattccagcttgggcgaaaaagtgagactgtgtctcaaaaaaaaaaaaaaaaagaaactattgtcaaccaatgagtgtaaaggtgttatttttgcttttttttaagtttatgttttgaaatcctctctcaattgcagraaaaaaaataagatacagaatataaagagacagcataaatgatagaaaacaaaataagcatgttcatgagccagaaatcaagaagaaaagrcaatgataaaaagggctgaagccggaggcatcccaggccmtgggtctggaagcaggtactcacagtggcattcttgggcactctggggcaccgaggtctgtaagtaccactcataaygtgrctggccagcaaaatttactgcttaacataaacaatgtctkggcccccaccttgcaaaataatgctgaaataaaaggtgttactgatcattgtctgggactaaggtttagtgaggtttacttacagaaaataaaaaagcaaacagtcatacacccaagattgggccaagctgcctgttggatttgacatatcctgcaatcacagggaaaaggttggtactatactgagatgtggctcaggatgggagaccacagggcaggcaggaaggaggcaaaagcaatctagaagacctgtgtgactagtgagaaaagcaagagtaagagaaaggaagaaagagagaagatggatgtcctcttgttaaaataaatgtactaaaacaaatagaacaatatgaaaagaccctacataggttaagtatcttccaaaaaagacacagcattcatgtgagcttcatattgctactatagcaaattgccacaaacttagtagcttaacacaacatgcattcattactttacagcagcttagacatccaacatggggcccactgggctcaaatccaggtgttggcagagctgcttttctttctgagactctagagaaaaatygtttgctttggtttttcarctctggagsctgctgyrttccttggctcttggmtgcctctccatcttcaaagtgcatcactgcagcctgcgcttcatccatcacgttggctytgtcgctcacatttctacttctctcttgcaaggacccttgggattctattggactcacctggataatccaagataatcttcatcttaaaatccttaatttagtcacacacagaaaatcacctctgttatgtaaagtaacatatttccatatcctggaggaagggggcattgatgtgtctaccacagcatccacaaagggaacaaaaaatattgtccaataaatgcatatagaaataaatttgtggattcaggaaaaagtgragtcatggaacaaaaatatttaatagatagaagagtttccagactagacatccaggaaagaattcacccaggatgcagcttagagaaaaygccaaggaatatgcgaaggaattgcatgcatgtacatgcgcgcgcgcgcacacacacacacacacacacacacacacacaccacatagaaaagaacaattcacagataggaggggtagatttagagactccgacatataaccatgaggtttacaataaaaagaataaaggagaaacaatactgaaaaaagtaaggaattttccacaattgaagaaaaacatgagccttcagataggatgtgcgtgtctcgtactgagaaaaataaatgaaaataaatccgcacagaggcacaaagtaatgaaattgtagcacgtcaaaatccatattctctttgggtttgacaggaggaataaattcaagagatgtattttacaatagggtaactacagttaataatatttattatactcttgaaagttgctgagtagattttaaatgctcttactataaaaatgataagtatattaaataatgcatatattaattagcttgatgtagccattctacagtatataagtatttcaaaacaacgttttgtacatgataaatacatagtcaaaataatttaagaatttttaaatgataaaaaatacattttaaaaattggaaggccatattcttaaaaactaaacatgagaaaagtattaccaacaaaaaataacaattaggcctctctagaaacctaactcttaaaaacagacattacagaatactttcaaaatgctttggcaaaaacaaaaaaccaaataacagggaaagagctctatgaattaaaaattttgcactcagataaagcattaatcaagatgaaatacaaaatgaagtacatggtttcttacagctcagttttcctatctggattaactttagttttgcaatagtatttcttgcagtaacgttctattatttgtgtgtccaaacatgcatatttatccagcaactaattcaaggtatgagaggaatgaagatactgatgacagaaattagagcagggaatcagaagagagaagtgcatgttcccttgcatggcactcttcagttgacaaaaggacatgtgatcccaagatttctcttgactgagactacatttacacaaattaaggagttgtgtaacattaaataaccaaagtcatagccttaggaacttccattgcaaaaaaggagtttaacatggagctgttgttaaagggagggtcagatggtcgaaaaattaattggcaaacaagttgattgcataagctggaagtactgttgaaaactttgtggttctttattaaacgaaaacacttcggatattgggaagacagcaacagtgaaatttccttggaatcaggaataagggcctttatatattctactcactgtctacatggtcatgatctcaagttattgtttctcatacatatcagagatgtgctaaaatttgaaataggttttcaatcaggagccaattctaatcacacatcagtggcaacttggagccttgagtttggaaagattttctttagtgtgttaggttgttcttgtgttgctataaagcaatatctgagactgggtaatttgtaaaaagagaggtttaattggctcacagttcttcaggccgtacaggtagcatagcaccgacatctgctcctggggagtcttgaaaaagaaggcaaagggtcagcaggtgtctcacatggcaggagcaggagcaagagtagggagaagtgccacacttttaaacaatcagatcccttaagaactcactcactattgcaaggacagcaccaaggggatgatgttacaacactcatgagaaatctatcaccatggtctaatcacctcccaccaagtctcacctccaacattggggattacatgtcagtgtgagactcaaagaagacacatatctgaactatatcatgtacaattccaagacaaagtctactaaagtctgagatcaattaattgtagatatctgtcattaggtaactgaaatagaaggaatggccacagaggtcttgtaggtttgtggcttgtgcaggtgtctgctgataaatgtttaacaataggttttcataggtggtcagggaaggccttatttgtagcatttgccaatctccctgatataaatattccaaccatggatgatttactcacaagatggaactgaattctgaccacagctgtctcttgctagctggtgtgagtcagctccagaacctcaggagtctggtggcttaatgctgaaacttagtatttaaagttgttatcttttgttcacctgtacggaagtaaagtatgggtgtgagaaaagtttcagttagtttagttagtatttataagaaagagtttaaaagaaaagaatggaaatggctcgtgggtcgcataattgagactatgaagagtggttgaataaattggtgtgttttatcctggagaggagggagctggagagtgatttaataatcttcatatttatggaggttttttttttttgacagaagatggttcccagttactttccatccctaagtttcaaatcaagataaatctagccttaagtattcccctttcctatccaataattatcgctttaaaaatattttagaaaaaaatgtactgtataaagaatgctttcttagattggttatcagttgatccagtttctacactttaaatcctgctggccttttacactatatgtaagattaggcaataaagatagggaaggttcaagggaaaacttctgaggccaagtaatccaataggaatccaatagcaatatgggaaggcaggaactattttacccaataactctagctagaaatttcaacaatcaccaaccattcctgctcccccacatgtcattcatcacactgcttcatgaattctaactccagaagtcctcttgaatttttcccagcctgtcctgtcaaatcgctggtctagtgcaagctactctttataatattgcaatctgttcttattccactttaaataaacagagtagagaattgttgaccagatgaataaaaagttggccaccaatttgacattatccccctaactaacattatcttaaagtatgcttctcaggagggcattttaagtcatttgaagttctaaatgcaagactgaatatcttctgcacctgttttcattggttcaatatgaaagattatactatttccaccatgttaccaaatatgattggcattgtgttaaatgttcttaggtttaatcactctgaatcctttgcctaaaatgtagatttttttttttgctataaaaaagacattagagtctatgccaaaatttgcaattcttctataaaattattttttgtctaaatcttaaaaataacttaaaatcactaaatgttcagggaaatctctagtgagaaaaataaaatttatagctcacagactagattgaacagacaaccatctgttcaacttaaaacatttgtctcaaataacataataactcacaaatgatgatggattaggtaacttcatttcatatttattaaattattaacccaactctttttaaagccatcaatttgcatgaagcttatgagtgagagatatacaaaaaaaacttaatatttgatgatctcctaatatgtgctaggtgctttatatgtatgacattttaacaaatatttaagtcagatactatctcttttttcagataaagaaattgagacttaaggtaaataatttacttacagtcacaaaaatgaagtacgcttatacaatctgaatctactgatggcttcaaaatccttttctacgatgaaatgtagcttcatgtaggggagtataacatggaaataaggcaggtagtttttcctttccaaatttttagtatagatgaagaaaaagacattctcaattatcaatactgtttaaaaacaatgtctttgatttaatatatggtaaatattaaatatgtggtcgtgaaaataagtatatttttagagttcaaaggggaggaaaatatcctttgtaagctggggcattttcaatattcaattttatttattttttataatgaaatagtcagcactccaaccatccatctatccaccaattcatccatttatctacctgtccatctattcatccatccaaacatctatgtatccatccattcacacatccattatttcatcctgcattcatacatccataactactctctaagaaagaagaaaaatttattcaggcttctatgtagatggaagtgttttgatactaaaatgtggatgtttgtaattttattattgccatttcctttccaaatgtatgccaatcatacatttttctaagacttatacattacctctgaaatgcttcctcttggaaatgatgcacgtcacttctactgacattttattggtcaaagcacatcacatagtcatgcctgagcctatcctcaggaagacaaggccatttgaccaggaaacacaggagatccagaaatattggtgaacactggtaacgtccatcaggctgaaaaaatgtggtataaatattaatatttaagacacaaagaggtatttaccatgataaaacatatttaagacaaaggtttttactaagagcaaaaacataaactttgtgttagtcagttctgtctactctaacagaataccatagactgggtggctttaacagcagacatttatttctcagccagttctgatggctggaagtctgagatcagggtgacagcttctcttgaggaccatccttctggctgcacactgctgacttctccttgtatgcttaagtggcagatagcagcgacttcctggagtgacaagggcttcaatcccattcgcgagggctccgcctcatgagctaatcacccaaagtctccacctcctaataccaacaccttgaggattagaatttcaaaatatgaactttggggcacacaaatatttagtccataacagccttggaggtaaaattctaagtagcagaaatctttcatctcttctaaaactaacactagtggaaaacataatctttcattcaacgcttagagtctgtcttggagagcaggaacagatgtattatattacatgtgcacacatacacatatacacacaaacatttgtttgtatgtgtgtgcttatgtggatatctatatgtcatatatacactgcatctagcacaataggtaattgctatgtcagggcacatttattatagttttctctctaactcataagggagagttttttaatcagctggtaatatcatatatttcagttttttcttgcaaataagagtggaatagaaagattttcgctgttgagaattgtgcccttaagtgttaacaatattcacaagtgtttaaagaaataattaggttcatttcattctatcatgcttgtactatatttataacatgacctttgttctatttatatatacaagtaatatattctaataggaatttttttgtgaagaagaaacacttgataatatcccaattccctaacagaattatacaatagttcctcaatgaccttaccttgggaaaaaattaaatgaaagacacctgcattagagatcaatttcctgatgctcagtttatattcatcatgctaagctatccaaggacacctttcttgtcctatcatttgatggaaacgatttccatgtgttttatgattcaactccattctgccttagacaatacagtcacttcaaacagttcaactctacagttggctggctgactttgccttgtaaaaattgctttttttttttttggttcagagtattctatattttacctaagaagtggaaaacaaattttgggcaagaatagtggcatacacattacagagtgatttcacatttcaatattatttacaaatatgacatcaaacattagtggttttatttcatttttatatcagaggcattctaaatatgatgtgacaaagttaactccgaatttcctggtttttgtcagtttaacccagatctttgctatgcagttctgaacactgccatgctttcaacttttcaacaagaaacaggtggttaatacacacatgtaactctacaacttgatcttagcatttcatgtaatactttggtaatgcctaaatattatgtttgtagttgtccggagcatcttattttcactttttcaattctatcaaagagtacattaatagaaaattaaccaaaactgaataagaataaaacctcacttccctaatttatcctcttatagaaaaatattttcagtgtttatatttatgtgataccagccgcatctgggttcagtaagcacgtgtttcgagcatactttgagatgcattgttccttggcgcacctcagtttgtactggaatcattaatgcataatctgaagttgtgattattgagatttttcactcaataatgggattcaaatgctgccctgtttgatctgcattaactgtttggaattccagaatattgactggcacttcagaagtcaccagagtattctgtagccttcagagggtaaatttcagtcacgtggggatgatttttttggcaaagagcattttgcactctgagtcatcacacacattctcacaagtttttaagcccaggacagtctccattccaccacttgtaggtaaactggtgatgattttaaaggtaatgtcagcctgagaaacagtgaaatatgctgaagatatggacacaggcacggagtctgcgtcatcttagtccctaactctcaccttagtgaattgttccaacaatgacataatgaattatatttaacttttcctgctgctcatgttttgatatttgtcatcaatcggagctggtgagagttttaataaagtgcttagcatcacctgagggtaaatttctatatcctttggattccttgatcctcctctgcactttatgtaatgagtgacctttctatctagttcaaatagagaatgtagagaagtaaagtgcttcatgcaagagggcatcactgatgtcaaaatgcagggccaacatgaaagaagggcagaaaggttccggacacaaagggcagggcactgcctggactggctagtgtcggggtttcagccagaaccttcctttagaatttggaaactatggagaaaacacagtgatgcagatcaatatataccagttttgttacagatgttgaagaaggtggctcactactgtgatcatacatttgggcttcccaactttttctcttgaattaaacatattactaaattggcaggcttttttcctaacaactgtgaaatgctagtctttagaaattttcagcatccagcagcaaataacatgcatgtccaacggcgaggatggctccaaaaaagagagaaccccaaatgaaaatgagtcaagcattcttttttctttaagcagagcaagatcattcttatcagaggaaattgtgagcagggtacaagaagctgcacatgcctaggaggtgagagttctgtctactccagggaaaaatgagaagtgttgaacaagcagcactcccagaaaataacacattgtagtagacgcccgttacggtttctccatgtattaaattggtttataacattgtctttttgtttgtctcttttgagtttataagttcccatcaatattttatttcctttacttattttgggtttaatttgtgcttttttctatctttaagataaaagcatagatgataactgattttagactttgcttattttctaatataggcatttaaagatgaaagtttcctcttacaactgatttagctgtattcttcaaattttacctttcaaaattttatagggtttatttttattattgttcaatttgaaatatttcctaatttcccttgtcagttccacttttacatacagattatttaaaattatgttgcttcccaaatatttgggaatttttacagatatattatactattgtttgtgatttctaatagaataccattatagtcagagaaaaatgtcatgtattatttcaatccttttaaatttatcacaacttgctttgtggttgagatggtgatctacctgagggaatgttttatatgcatagaacagataaagtgtattcttcaattgttgaatataatgttctatatgtgtcatttagactaatattgatattgttgaagtcttctaggtccttattaattttttatctattagttatattaattgctgaaaaagcatgtttaatgtctgtgattggagtcttttctgtaattctccttcagttttttaaattgttacatttatgtagtttaaagctttgtgattatatttatccacatatttaattggaaatttttgttgttttaaaaatgtttaccctttctggggctttttcttccttccaacctggtatttttcctcttcagcctgaagaagttacctcagcattttttatagaacaggtctgctccagacgattcagatttttctggtgaacatataaaaatatacagaaatgcttttaaggcattgtctcaggatatttgctatcatgtttacagtcttttatcttctactatctttcaacttttttttttttttttttttttgagacggagtctcactctgtcgcccaggctggagtgcagtggcgcgatctcggctcactgcaagctccgcctcccgggttcatgccattctcctgcctcagcctcccgagtagctgggactacaggcgcccgccaccgctcccggctaattttttttttttttttttttgtatgtttagtggagacggggtttcacagtgttagccaggatagtctcaatctcctgaccttgtgatctgcccgccttggcctcccaaagtgctgggattacaggcgtgagccactgcacccggccatctttcaacaatttaaaaacattttatggtcttctagtttcattcatcttatgagcacaatgcgtgttttttatctcctccagcctctttcaagattttctattcatgtttggttttcatcaccgatttgatgatcgtttgcctagttcttgttatatttgaatgtatttactgtttcttatatatgtgagttgatatatttcatctaatttagaaaattgtcacccatgttctcttcaaaaatgtcttctacctcattatctgtcctctttttacaagacccttaacgtaaatatatttgatggcataatattttctacacatctcagatggctctccttttcgtttttattttattttattttattttatttttgagaggagtctcactctgtcacccaggctggagtgcagtggtgcaatctcggctcactgaaacctctacctcctgggttcaagtgattctgctgcctcagcctcccgagtagctgggactacaggtgcctgccaccatgcccagctaattttgtattttaatagagatggggtttcaccatgttggtcaggctggtctcgaactcctgacctcagatgatacacccaccttggcctgccaaagtactgggattacaggcatggctctcctttccttcttctcttctgtatttttctccttcttcctctccatctctccctccctccttttttttttcttatatttcaatgtgggtgatttctattgatctatcttcttgtttactgattcttttctttggtatgccagtttactaatagacctgtccaattaattccccatctcwatattttattttttttccctattcttgacatttggctttttagttgtgtttatttctctgctaaaattcttcattttttttctgaaaaattgtctaaaaatagtgttagattatctgacatatctattatatttaatataaaactcctctctgataatttcaacatctatatttggaactgcctctatttctctttcttcccttgcccatatggcatagttatgtttatacatcctataatgtatatatatatagcttcttcatgtcttgtaattttttacgatcccttccatttaacagggcatgagatctaagcaagggagagcctcggatttctctttgggctttataacccagctgctgactccctgagtccgggcttccagtgaattctctttgctgtctggttgctcacccagccttttcacaactcagatttctacgctttgctgctcagctctgagcctttgaggcttgagtggactcagtgaagtccccgggagccttggaggtgtttcccactgctgtcctactctacccagctttccgcaacagctttttggcttagagggttttctcatggctctcctgagctgctcccagcctcaagtcagctatataagcctccatttttcagatcccctactgtgcccccaaacttgggtgcattatgtccatgtactaaagtaaaggccccctgggacagagaggtgggtgggtgcagagctgcctctgatggagcttcctcagggacctgagtcatcacacttcataagctttttaaaatgtgttgaaaattggacttgtttctcacatccctttgctggcaaatccctcctcctcttcccatcactccacctagcatcagggaagcacttcattcctctctcataggaagagatcatgactttctagattttctttcagttaggctttttttgcatctccagctcttcattggctcttataaactgtgttttgttattgttgttttcaagttatccatcttgttctcatttgtagttctcttatggctttctaattcctaaccagaagtggaaactgctagctattgtttataacatggtccatttgcagtttataggggtggtatatgaatcaagtgtggaaaggaccagaaaaaaattgtaatggcagatgttatgttgtcttaagccttgctttgcttttgccactgaggctgtgttgtttttaatcttactgtgcatggcaccttctcatcacactagtgttttgccttccaggggtatcatccatataaataaactgctggaaggccaggcgtggtggctaacacctgtaatctcagcattttgggagatgaggcaggtggatcacttgaggtcaggacttcgagatcagcctggccaacatggtgaaactcgtctctactaaaaatacaaaaatgagccaggtctggtggcacacgcctgtagtcccagctactcagaaggctgaggctggagaatcacttgaacctgggaggtggaggttgcggtcagccaacgttgctccactgcacttcagcctgggcagcagagcaaaactccatctcaaaaaataaaagtgaataaaaaataaaaataaactgctggaagaagtttatgaggtatcctaagacatgtacaaatactagtgtaagacccaactgggaatctttatgtcttatttcgtccacagctccccacccacaccatggatttaagaaagtcttttaaaacatttgtagatcaagctatctggttctaaaacatttgtagatcaagctatctggttttcaaggaatttatattaagattgattttcaaatcctgtgtgctctagtctaggaggataattatttgttaatgtagatatttcatagagacttcaggcaaacacatgaatgaggagcaaggaaagacccaaagaaagcatgtaagtagatatcctaaatcaaattgttatttgaccaaagaatttggtgatatgataaaatccaatttctaaataatgagtttttctgttaaagctctcaatatgaattaggaaagccttcagctacacgtaaaagaaaatctaactcatagagttttaaacaaatgatgagtcttttctttttccttaaatctcctggaatcctgttgacattggattagcaacaatggtgtcaaggactgaaagctagtgattgcttttgctttagacttcatgcctacattcaaaacaagaagagggtaggatacagcgtcattcattctgcatcatcaggaaagcaaaaagccttcctagaagcctcttggcagtcatatacttaacacctttttggcagaaactgggtcatgtgtccgtgtctaggtgtgagagagggatggaaggtgggaacatggagttgttaggccaattgtatttcatctcttgggaatggggggattgatattgggtagacaaaaatcagttgttatcactctacctaagtgttcctctgaaatatattacttgattctggaactttatttgaaaagttatttgatattcaatagttataatggtaatccaatacaaaatatatatgttgcctttaaaatgataaatagcaatttaatatctagagtaatctcatctacatttgacagtaatattaactattctattctcataaatcttgtatcatttttttgttaaattgtcattaatttaagtaaggaaaagtagagtttatttcccagtcacaaatagaagtaaccggttgttgtaaaattatcaatgtttctttcttgaaccactgcaccttgaattttgattaaagagtcgaagtattgttaacatccgtggaacttagaaaaaataccagtgctaaccacatcacatctaaaatataagcacatttcaaatttatgtgaattttaaataatctgttttctttggcttgtagaaaaattaccaaatagcatattgtattaagaatgaaatgttctgtaatcaagatcaaattacaatcttataataataacagataattgtatacatgcaatattaaagtatatgagcatattctttagacaaaatatccaaagacatcaatgttttcattattaaagagttactttccagttcactgaataaatgaaaatattaagaatttggttatattaagaataaactctaagatgtttcttttacttcagtatgaaaagcatgcaaaaatgataactacattttgttatgatggtttgaaaaatctggcataatttaaaagcaactttccatctggctggtgcagtaagcaagtggaattagaagagttggtctctgtttcttgatgtgaatgattgtgattagtctgatttctttggtttgcttttattactgttttcacttcttttcttggtatatgtgtgtggatatgcatacaggatgacatttctatcacattatggcttaacaaataaaacagaaaatatgtttactttggatgtgtgtgtatttttggagacggtatttgttgcctactcaacagtgttctttttacttcttggcagcctccttggtataaccacgcatttacggaagatgacgttaccagcagccctggggtaagtctcagtcatccgaagccagtcttggtaatcccagcagactagcaagggaacacaacctagttctgtcaagtggaaagtgaagagagctgtgctgggaggcttctcagaaaaggtttcttttggcaaaagaaagagaggggggaacagttctttttcttctgccggacaaggtcatgtgtgtacgtaagaactggaagttctcatgcccactgagcatggggagagtcctgtctagggtgacctggtgagaacagacaacccttgagccaccttaccctaggaactcctggtgataagacagaatacattttttctcactgttaaactcttttttattatttgtagctgggtgcctccaaaccaatataattagccgtatgtaaatattctgaaatctctgtcaattcaaataacatttagggtttttttcccagtgatcaaaaatacagcatctcaagcaatattgtgtgtgtgtgtgtgtgtgtgtgtgtgtgtgtgtgatattattacataataattggaagacttttgatgtagatcctagtggtgatcttaaatgttgagtatttgactttttttagcatttaataattgtcacaataaatttatatggagagatattttaattatagaaactcattagtttgtccataatgtaaaagagttaaataatatagttctgttgataatgatattttgtaatagatatttttaagctgttaggcatgaaggaaaataatgttgtaagtaatcagttttatatagggtttatagatatttttattatttggtattgtcatgttgtttcatgcctcataatagctgattacaaatagattttaatcaatcactctctttattccaaaggtttaagcagataaagaatacagagaatgcttgtaaagcattttctaccaatatattaggaccatttctggataaggtccttgacttcttcttttaatcgtttctaaaataacatttccaaaaacctcaagcaaaaccactttaaaaaatctgaattcatataattttacctaatgtggaagattgggagagcagtgactttaatataatattttaatgtcaatgtgtgtacatctgtaattaataaaattagtacaattcacaacacatggtcgttcttaagcgacagagacatagaaatgtaacagcacattaaaatcctcttctagtggccccgagctgcaccccataaactctttgatagctcttaacaaatgcaaattaatgagcattaacccaggcattcgaaggtccagataaatcaccatgctcttcaggaattcatatgaacaattcacagtgctataatttttcctaagttaagactagactaatgttgagagagacagaaagagaaacaaaatataggtgcactctcctctgctcattatagggttctcttcgaccttgaggagactgctacttggggacatgtactgattcattttctgactccttttgtccttgattttgacatagccttggtgttgggaaattcttccctcaaagcctcaatcgctcatgctcaaatttaaacacatttccttttctgtaatcagtgagggaagagcagctggtcaccatcttctacacactaaacctttgagccttttcttcagaataaatgatcctacttcttagaatcataaaattagaaggggttttgatgtcagaccatcctttttctgcctttagacaagactacccttccctcttaccatcccatacagatgagcaaaaccatcctatttttaaaagagatcaagagaaactaatcaaaagcctccaacagtcacacattcctctgatgagcaacccttactttcaggaaatcatcatcattatcatcaaatagcattttcctaacacccacatgtgcaaaatatgtttgtgtattcagatcctaaagagggccctagaggcccagaaaaggttggaaaaagaaaaaaaaaaaacgtgcaaaggtacacaagcatcactaggctctttgcaagagagtctagttcattgcaataataaattatttttaaaagacattccagaaactccaggggattttcattttctatttaggaaagcgatcttataattaaagaatatatccattcattttcttttgtttaactattaggacttagtaatgactatcaaactcaagtctaatgaccaaagattgagaacataaatatgcagtgtattaaatctgaaacaaatccatactaaggttttaaaatttgcaacacgtataatactgaaccagttgtctctgttacaaagtgtgtatgtattgaggggaattgtctggaaaaatgtttaaagctctcttctctcccattctggctcctcctttatgctcctggagaacagagctcaaaggctgctctcaaatgttcaaaactccccacccatggctggaatggctctatgtccttcagtttcaccttccagtcaaggaattcccaatttctgagtattactgatttttgctaggttttaactaaataaagcaatttaattgaaggtaagccttcccttaatttataaatatttgataaagggaaaatttgccagtcgaacatgctgcttgatgcggtgggggggattttgacctgggtggcactccagtctggacttcaccttacctttaattgctctgccaggggatgcaacacagagtaaggtcccacgtcatccattcactccttcctctttttgggtttctcagctcctctccattgctcaccttcacgagaagttccctgtaaccgtgaaggttatcacaaggctcagagggtaggagctgacccagcacctgcagatcctgaagggcccctaatctaaatacaccattcaccccaacaggtgggaaacaatttgatacacaggctcaaaagtttgttttgattactgttgctgtgaagttttgatttggcctcctaaagtagaggagccaatttgatatttcattgcataattcctgtactatagtagtaggtactatctagcaagactttactgcaaacataaaatatattaatagaacatacaatggtattggcatacagctctttttattttttatcttttctaatagatatgtttattctatttcctaaacgtattcaagacttaaaattttcactaccaatgaataacatgcttaaatattttagggaaatggtaaaatggtaaacagctctattagtattattgaatatctcatatttgaaaggaaagaaagtgacacttgctgctttctcatacgctatcacatttaaacctaattacatttcaagacaagaatatttatcatctttttttctgttaaagaagttgagcctcctttacgataaactgaactcaaatgtaagcatctctaattctggagtgcatatgtgcacaattacataaataatttggtttaagaatcaacaaaactaaataaatgttaggtttctagaatttatccaaacatcatgatgattgactatttattgccgattttcctattgtaatatgcagaagtttcaattttaagatataatcgttatgttctccttatttgatctcgtatttccacagagctactctgtcattaagtgtacctaaattcttctccatagccttttaagattttccgatgtttatctgttctctgtatcagtctcgatcactgtcttcactctaaaagctgcacttaatagcttacttaccgaattagtaatttgggaattaccgtatagttacatggaaatattacttccctctgtgccacagactgggctttgattacttcgatttcaatgtcccagcagcatccagattttatgaataccatttccgatgctttgcttaaagttaggggccaggcctgagctcaagtctcaaggctgatgttgttaatatcaggacaggcgggttcaaaagcacaggcgccagctgccccacctccatggcacagccgtcatggagccagccacaggtctgtttcagattgcaaaggagggtctctgacttctgtttgcttttgtgctctaggaagacattgtaggcctccataaacaaaaataaaatgaaatcgaattacaacttctttttaacctatttaggatgtaaaggttaaatatatatgtatctatgaagaaatgcatgttaaaaagtggtttgaaataagacatgcggaagcaaaattcatttttctttgtatgggtaagtagtatgtttttctttgtatgggtaagtagtatggctaagtagtatgttttctttgtatgggtaagtagtatgacaatacgccataatcattgtccttatctattaactaaacctcaatgagaaagataaattattacattgcagagatatgagacttaagacttactcaaaaaattttaaaggctattccttaatgtaatacacttctatcaggaatagtacagaattttatctgagatatttgtattaatcaatatttttgattcatatgaatcattatttggatcagattttgatccaaataaatgtgaagtatattgaataattcagaattaattagtttccatttaatcagttcaatccttctgagttcatgattaggcaatttggaaaagactatataaaataatattctatttgaactatggaagtattcaaaagaaactggtaagttcatgagtataattgtccaagtgagctctgtaatctatgaatatataggaagttcttgtctttgagaatacatggtttaagtgaattctattatctatattgtcattttgattgtatttcaatttcgttatgtgtaaacggaagcaatggatgtactctttgaaaacagtttcacaaattaagaactttaaacaagcttttatcttctatttaggtcaatttgtctaagtatttgaggtaattttcatcctcatctttttatttgttatcttgtccaatcctattaatgagcataaatggctccccaagtgtaaatatttgaagggaaagattgggtcattgtaaattcaggtagcatccatagttgatgacagaatgacgggaagaaactttcctcactaaatgtcaatcaaattcatcagcatgatacttttacatgtctgcacagctggaaaaaacagtcaattctgtttcattgttatgtaaatttatgctgatactcaatgtaatcaacaaccgatgctagaaccatccttgaaacagattagatgattggattctttttaatataattctgaaactggaaccctaggtttttcttaggcacttcttaaatatttatggttatccagcataagtaacacagaaattctgtggtcagctagtataatctttttcaagcagtgtatgctattcttatacccacaccaacaaaattgtatctaaaacattggtatctaacctaggaaaaatctcaggtaaggttttacgattcagtgccttagtccccttaagtcatttcggccacagccttaaaaccctcctttaaagggatttaccatcacctcttgtaaaaactggatttgagcaagatgcattttattaatcaaatccataaggcagtcaatacattacttcttttggaatgaaaaaggaaaagagttatttcacaagcagatgaagactacatatgtaactctacttccctcggtaggctccaatacaggtttaatcctgaattttcccattttgaaaggcttgccaagtcagttctcagacctttcgtgaaacatgttgctcagaagtgacatcaaacgtgatcctaatttttgacagattcttctatacaatgacacatacctggccttcaaaatagagtaaactaaaactcactgaagaagaacaaaaaggtcactcttaccattcttgaggatttcgaaaatcaatgatcctacagaaggagaagaggccatttatcattatagcctttttgatgtcaaagaagaaaaagaaaaagaaacagaaaaacatgcctttaacatagcagctgatattagtagctttagaatttacaaagcactttactgttccgttatttcaattaacactcataatgttgttgttcagccagtcttaacatttgtgttataattatttcctttgaaagctgaggacaggagggtcaaataacttgtatcatttcccaaagtcttgcagctgataagtgatggttctaggagtctatctccgaaagattgagcatgaaatctgttttttttttccattccattgaagtgtgtatttactaactgggtatataattatgaattgaagactaacctttatttaaattagtgcaatcagactatatccagaatatttctagaaatgatttttaagtgattgatgagtaaaatgaagggtaaaatattttttgtttgttcacttaaatgcaaaccctctgagttaaaattttctcaataattatgtagttcaaacaatattttccaagattatttgaacttagatacaattactgaatttaggcatatatacattagggtttcttaatcttggcatcattggcttttaagtggaataattatttgttttaggaagctgtcctgtgcattgtgggatttggggcatcctgccctctacttaccagatgctaacagtactccaggttgtgacatcctcaaatatctttagaaattgccaaatcatacttaggtgagaatcaatggtctgtattaatttaactgcaaagacaagtgctgtttctaaatattacactggacaattctaaaggtttaccataaattagcagaggcattaatcttttaatgatagtattgtagtggatatactggtacaggacatagctatctaagctaattctatatatacagtagaccaaaactgacacattccaggcatcccttctaatcttcctttgactcctcttatctagagtgaaaattttcttagcttattttgcatcttcccagcatatcttcactgggagaaaattcgtctctcacatttttgcacatcttgcaagtcaggcactgaccacctttttgttctggattctcttttgaggatgtttatatagcaaacatccttggaaatgaagaatcatttctgcctgtgaaacagtgtgcaaacatacttactccccattatagaacattcaggttccctaagttcaggttcctcttcccctataaattcctttgccccttgtaaattattgttttacatgatcctctttgtgttgccatgtgggaacaaaatgttgatactctggatactgctgttactaaacttttcttgatctctgtcccaggagtcttctcattgcttcctactagaattcatgtatccatattaggatacattttttgttttgccagaaaggcaaaatccccagtccttctcattactatgtttttgttgtttgtttgtttgtttgtttttatgcagcctcggcgctctgtcactcaggttggagtgcaatctcagctcactgcaacttctgcctcctggattcaagccattcctctgcctcagcctcccaagtagctgggattacaggcgtgcaccaccacgccaggctaatttttgtatttttagtagagatggggtttcaccatgttagacaggctggtctcgaactgctgaccttgaaaatctgtcctttgaaatgaatgacaaattacatgctatttatgccccaaaatgctaacttccacatatatcattttagtatatccttatagattatctcacatgaaatttctttttgcacccattgaaagattattcctgaggatgtcatccactctatcacttattgtttcctctttatataagcatattgtctttttaaaggaaagctgatttttacctaaacaacagtttcatttctttatagacatcacaaaagttgcgagttactgcatttgcatcctgcctatctcttttaggaaatgaaggcttccttttttaagccaacctctagcagctgcataatatcattgatagtaatgttgggtgttaaccttaccactgatttattacttttctacttttaaataattgggtatctgaggaaatggaaataagatatatattaaatataggtgtgtgtatatatatatatatatatattcaagtatgtatagtttcatgccaacctccatattctatatataaatatatattacatattatattatatatatgtatgcgccaacatcttaaaaagtttacatagaaagacatcttggaataaattgctattattagtggagtggggggaagaatcacatgagcaatctaggtagcaatatatctaccctacatgaagaagatcacatgatctttggtgtttctcattgagtatccgggttagtagataacttattgacacagggatcccagagatcctcagggaggaaagtgattgtgaccccaacacaaagcttgggaaagtgatggaatggactagagtggcacttgacaaactattctgagagtagcactccaggagcatttggagaattcacaaggatggtaacattaataacaagggtggcttgatactagttttcaacacaagctctggccgtcctaagaaaaggctttttctggccaaaagtgttgcttactctggaaatccctaagcactggccattcttgcatgaagtctttcttcgggaaaacatgcgtaaatgattgaatataaattcaaagaattttaattgttgagcccaagtatagagtgacttcactcttctctggggactgaagtggaaagaccaagtgtccttcaggatgcgtggactccatattccacaacattgtgtggcagcatcagaagccactgccccagtcggtgaaaaccaccctctccaccttctccactctatctttctataaacaggatgactgattcccatacactgaattgaccctggaattcatggacattgtggtttttgtttgtttttgttcggttggttgtttagttgattgagagaagtgaggggaaatgataatatcagatggggagaataaattgattaaaatttcttaaaaggggccgggtatggtggctcacacctgtaatcccagcactttgggaggccgaggtgggtggatcacctgagatcagaagttcaagaccagcctggctaacatagtgaaacccagtctctactaaaaatacaaaaaactagcagggcatggtggcgggtgcctgtaatcccagctgctcgggaggctgaggcaagagaattgcttgaacctgggaagcagaggttgcagtgagctgaggtcacgccattgcactccagcctgggcaacaagagtgaaactccatcacacacacacacacacacacacacacacaaaattaattaaaaggtaataaaagaagcacgatcatgcagagcgttatgctggctacttttacatttttacttttacattactcatctatgtttcattattttatgtgagtttttagatctacttaggcatttgtaggtcaggtttgtttaatagttaaattcatctacaatcaatcttactttatgcatatatgtatttatagatacttagaatgacattaaagattttggtagctaaatctggccagtacaaaaaatatatattatctctagcctaaaatggaatgttgtcatttatgagttcattgttacctgactgtggtatctgactaaaaaaaattatcatagtatagattgctattttttagaatgaattattttaaggaagcacttccatggaccataatctcagagttggacaagagttctaaaacacaatgtagaaaaattgtcaatattgtcagttattaatgatttccagtgatataacacaactaaataaagtaaaataaaaaaatgatcccatttaactggtacttctaggaaattcaggtaggtgtctgaggtcactgaagaaactgggtcggttaccatatggtgtaatctaatctctttcaattctgtaagtctgaaatatatggtattttcaatgctttttttttttgagtattacattaagtcaggaaacagtctcttggcttgacgtttgagaggcagtgcaaaaagccttctactttcagtgctatggcattgctgatcacaatatatctatgacattctgatacaagatctgagaaataaacagaaaaagggtcagtcatttcagagaggtgattccattataaaggtgggtatgtgtagcattttcttgagaaacttttaagtttttctttgatttttctctaagttttaagagccctaagctgataaatacttaatgaattttcagtaatagtagacaacttccattagtattaaataacctttgtgaatcaacttgtataaatcacaacacaaatagtgaaaacaaaacaaagcaacaaaaaacgctaaactaaactacaaagaagtcttgagtgtttggatctgacccaaagtgaccattaaagttgtaaattttctcattaaattgataacaatgtaagccattctctacatcaattgaaatgccaacgtacttctgagtaataacatcccttccatgtggtctctgatattttgattctagctttttacgagcatgagtatattctttattttgaaggctgtgttgatagatggctctgaattggagggctaccaaaatctaaagggattctttgctgcttgtcatggttacagtcctttttctcttcagtagcttttgcttatctaaaatgatgaactttctcagtagatgtgcaattcaatcgagtcatcttttcccagatacaggaatggttattaatattctgccctctcagttctctatgataccctttatgaccattcagacacaggcattcatacctcactgaggacagcagggacaggatatgctgctgtgataacaactgaaccaatgacttggcttcatgctctctaagagctgccaactccagtgcgcccaataacttccaccccttcactacttggtccagtggtcagatggtgggtggatggggcactgcaaggcactgctttctgctgttctgctctaactcctgaccagatttcacaaacagcgtgtgctagctttaccatccacaaatgcagagaacttttgggggaatactttgcacagccctcaaccagttctttcctaaaatgtatgtgaagtcaccaaacacattgaaggttctcagtagattttcttccttctgtctttcagtttggttacctcgcctctttgttttcattgctttcagattctttatttatagaagggaaaggggaaaagctgtataccacagccaaaatttcaattttgaaaaaattccaatctacagaaaagtttcaaatttatagaaacaaaagtataataaatactagtaaatacctttcaattaaattcaccagttacaaattttgccacatttgcttttttctccctcattatctctatatctatccatctatctacctggctacatctctgtgtctgtctttgtgtctgtatattacacatacacacacagatgtgttaccttttctatccttttctatgtttactctagaaatcatgacaatatagatcatgtataagaaaatcagtaataagttaatattatccaatacatagatttacttatactgtaatttgtggtttcaccgtagtttgctttgctttgttttgtttctgatctctatattctctttcatggaaagagaatgtttatctgtgtggtgacttggtttattttggtttccgtaactgaatttctgaagaatccagaggagttatcattagaatgttctgcattctgaatttgtctcattgtttccttctgtttagcagcaagtaaaacatttcttctgttaagcagcaagtaaaacatagcaagaatactatgtaggtgatattgtgcacttaaagcatttgaacaggaggcacataattttatgttgctccattactgatgatgctggtttaatgacttggttatgatggtgactgccaggtgactccattatgaaggtgggtatgtgtgtgtatatatatatgatgtaagagtgtgtatacatatatatatgtgtgtgtgtatatatgtgtgtatatatatgtgtgtgacacacgtatatttatacagtaaatatatacatatgtatatgtatcacacaacattatatttatacggtaaatatatatatgtatatgatacatgataagtgaagaattgtggccttgtggcaatgtgagcatccttcttcctaaaaattttcatccagtagtttttatcatctaataattggtccttggtaaaaacagttattattatgtattgaaaaaaagatgatatttctaattttgtcatattcttcttattttttaactggcattctttgaaaattacctttctctttatatatatatatattttttttttcatgattctaagttatgtatttaaggtattttaaatattttaagcatcttgaaaaatttaaagtaggacatgttttataattactgtgatttcttatataaacatcacattttgataaaaataaagagtatattacataaactcattaaagtcttaaatttatacacttatctgtttcctttcaaagcaatttttgttaaaggtaggaaggagtaaaatccactgtgccttgggttttcattttctattccaactaagaagtgctgtccacagaaatgtatcattcagccactcagtcaaactttcctgagaacctgcctccatcaagggacttcgttagctgtaaagtgctgactaaacttgtgtttatacctccactcatgaaataggaaatatacacacacatacacacatatgcattcgtgtttatacctccactcatgaaataggaaatatccacacacatacacacataggcattcgtgtttatacctccactcatgaaataggaaatacaaacacacacacatacacacatacgcattcgtatttatacctccactcatgaaataggaaatatccacacacatacacacatatgcattcgtgtttatacctccactcatgaaataggaaatacacacacacacacacacatacacacatatgcatttgtgtttatacctccactgatgaaataggaaatatagacacacacatacacacatacgcattcgtgtttatacatccacttatgaagtaggaaatacatacacacacacacatacacacatacgcattcgtgtttatatctccactcatgaaataggaaatatacacacacacatacacacatacatttgtgtttttacctccactcatgaaataggaaatacacacacacacccatttgtgtttatacctccactaatgatataggaaatacacacacacacatacatatgcaaccatgtttatacctccactcatgaaataggaaatacacacacacacacatacatttgtgtttttacctccactcatgaaatagaatatgtgcatataatatatattatgtaaataaaattatatatatttatataatatacaattttctaatatgggctgcaggccaatatacatagatttctcctggctgcaggtgaccatgtcacttgcattgattataatatattttaattcatggaatttaaataaagttttaacatcagagactttcacagagattcagataacttgagatagtacataatatgtttaaaaagctaatttttttctgtgaatattgcttgtttccatagacgtttcattctacaaaggttcaaaatataattttaactaacaaactatgaaggtaattgtacccattctgcagtctgttagcagcttttgattagattctcatagcagaattttcccatatacagttgctaatatagaagaaaaatatcatctccttattggattatattgttaacttgcttttgcttaatattttggcatcttttggtaaatttctggaatgaataacaataatttacgcagaataatctaataaaggatatttatagcctatgtgaaaataaagatacgcattttagggacttttgcagagatacaaacacttgttctgtaaaatatttgttaaacgtagcacatagggaaagcacagatcctggagtgaaaaacctacagcttgaattccactccagcatttattagaccagtgacttggtcaagttgcttagtttctctgaacatcaatttacttgtccataaagagagagtggtggtacataatagatattttgacaggctgttaaaagctagagatgaagcgtgtcgggagtctgatgcatagtacttctattaggcaaggtttttcagaggaaaaagaaccaataggatgtgtatgtatacatatgtacacacacacacacacacacacacacacatatgaatgagagacatttaatttaaggaactgggtcatgtgatcatggggctggcaaatctgaaatattcaggacaggcaggcaggtctgaagacaagggaggttttaacactgcgcttccagtccaaaggcagtctggaggcagaattccttcttcctcagggaacctcagtctttttctcttaaggctttcaactgattagataagtcacgcacattataaaggacaacctgctttaatgagtctactgatttcgatgtggatctcatctgaaaaataccttcgcagaaacacttagtctgaggtttaaccacatttctgggtgctacagataaaattagctatcacagaacgtctacacagaaaggtactgacatttgttaaaaccatagaattctatttacatgaccaaccagaatgtgtctagagggctccagtgcccctgcagattttctatttgtgctggcagtttcttggatagcgtctcctattggctgctcttactttctgtctttccattgtttctttgaggtttcataggaacagtcctgttttagttaaaagtgccgctggctcccagggtcccaaagccaatgagtagataatgaatggcaagcaatacctgatcccatacagaagagggaaaacccttctctcccacacctgtgccttaaggtagcactgtttatttaacagacttgcaaaaatctaccatgaaaacagtgacttcaacttctaatttagcttttctcccaattcatgctcaaaccaattcctcaaattgagaagcaaggacgagaaatgctycatcagttaccttcattacagtcgtatctctcgaggtgcactaaattcctttgtcttcaactgattctctcctctcccaacaggagatcaatgtacagaggaatagttcctttaaatccaggagtgcatgcaactaagcaactttagagatgaatggttgcatattccccggagccaattctagttgagctcaaatgatatattcttaaaaatagtaattctatttattttacaagtgctatgtaaacagagaggtaagtaccagcattataattcactaaaaagacctgattttgctgcacaaacataactaaatggctacaccctttaattgcagaatccagatttcctccaaactttatctcattccagtcaggaaaacagctatcgtctttttttttttcatcaaatgcttttattatcatgtttgaagcttttgattaagttggcatcgtaagaaaccctttcctattttctttcatgtttttcttgacaagcctgagtccgtcattctggctggtattacaggttcatgtttttgggtacattcatttatcatggagtgagtcactttgctgtttttgtttccactgtattctgaaaagcacccacagaaacatgacaagaatgcaggcttgcatggaagaaattctcatgccgggtctgctctgtctccccagtcagtctatcctgcataacgtcgtctttaaacaatagaaagcaatggctaaggataaaagaatgggttcagataaaactgaattttctaccaccctgaatattcactccatatttaatctgaagccaaatattttaacataaatgtatctttattgtctttgtcctggtcttccaatagggragtttttgtacgtggtacctctttgtttttttgtttgttggcttctactattttcttaattttaaattctaagcctccaggtgtcttgcttataaaaacgattctggattttctacttttaaaatatggtttcttaaccatttgcagttttgctaagaggaaaggagaatctataaagtatgtttacatgaaaggaaaatctctgtataacattctatcaaaactgtaataaagtgaaaattaattattaatattgatatgatttggctgttccctccaaatctcatgttgagatgtgatccccagtgttggaggtggagtctgctgagaggtgttcgggtcattgggatggatccctcatggcttggtgctgtccttccccactctctcttgctcctgctctggctgtatgacgtgcctgctcccctttcgccttctgccatgagcaaaagctccctgaagcttcccgagaagctgagcagatgctggtgccatgcttgtacagtctgcagaactgtgagccaattaaacctctttcctttataaactactcagtcttaggtactgcttggtagcaatgcaacaacagcctaatacaagtatacataatggaaagtgagccatgccatttgttcctttgaatatatttggacaattaaaccaacaataaaaaaaagaaattatatgcagtttctgactcgggttccttgaacttaagtggtagcagaagattcccctatctggaagagagaaagtcttcctaggaaaatgcaggagctgtttcaagtgtgtaatggagcagcattcttctgaaacacatttttgcttggaagcctaacatataaataaaaatatgaagagggagcttttctatttaaggtgtgagaagagggtgtcgggtgcccggttctacctcgttaagctcctttcaaatgctgagatgccatcgacccctgattctgtctcccaggaactcagactcaaaactcttgcaccagaaacaactagatggagaaaactacctgacaaaagtcctggacgatggccttgaaatcaattccttcatgtctttagagggtctctgtagtttttccataggtgcttaccagccacattcttggaggcgagctggctaaagtaaaattctgaactgaactgagcttgatagagttctgtgctcatattcccagcacagtctccatgttgggagggaaaattgctttttctcccattgcagtaaaaaaaaaaaaaaaaagtcaatgatcaagtctagattccttacaacttctgttagtttcctgcactccatggataatcaaattcctcgcaacaaaacagatgagctgtccctcaaaattgttgacttgtgccttattaggttggtagaagtgagaatgtggtattttaaattctcaagactgacttcgtgtatccatagagaataatgtattttatcctattttcttaactctgtatgtatttgaataagggcgatttaaaagttctctcacatcagtagaaataactgagctagagtttgcttgttgacaatgtataggyacaatatatcattagaagagtgataatgacttttattttggtgaaataataaaaaaggaatcataaaaatagagctgtctaataatgaaccatgtgtttaaaaaagaaaagttaactttctcatcactggaaataaggaatgagccagtggccatggatcacagatataattgtaaagattcctatattgagtgggaacrcagacaaaataacccccaaagtctttgctaaatctatggtcatataaaagaaatacagctggattgcctatcaaaaagatccagggcagtggatactaactttctttacttgcagccaaagttttgaaatcttagtagagcgttttgctttaaatttaatttattaaccctgattactgcagtcagcaaattaaactcaagcctgtattatgaaatattatgaaataaacactttagaactgtcatctgtattaagcagctgtaaaaaagcagtgtcaagccttgatgatttcatataaaattgaaataattttgaatattcctcatggtgatttgtatgttttgttatgcagacacagaataaaaacaagtgaaccaaaaaaaaatgttatttaaaaatacttaagaaaaaaaacaatttggaaaaaaatctcgatatcggcactaatttaactttgtaaattttccaatgtagttcatgttcagtatattagcataatattgattgtattagaggggctcagtatttcttacggacttaagtatgtttaagtaagagcatatccattttgattaatgaggtctatataccttctctcttgattactctccagttttggggaaatcactttggtagctgcattagctcttttaggtcacctgaaaacttcttaataaactaagtggtacactagtaaacaaaaagaactcacgcggcttcccttgaaacgaatacatcactgggaattctgagaaaccaattaaaacagaattattgttttgaatgaatcatcagagaattctagtctaaactcttctaaaaacctacatttctttctaattttattacattaaatttaaagatttttttcaaactttttgaatgagaatagtcatcagattattttaaaagattaggctaaaatatgcaaaattcccttcagtaatacatttttttaactggaattataattagtcataaggggaaagtcattttagtgggaaataaaattcaaaaaagctaaacattaactgctgaagttgctttttgccctttgcaaattctttcttcattatatcattctctctatatttttgaatgcatatatttccaaagaaattactttttgcttaatataaaattttaggcaattagatgcaaaagtgtagtaaagcaacactaaagttgccaatttaaacatagggaagcaaaacagcccaggagttaaagttctgacagctatcttaactagcacacatggccagtgccactcagtacacagacacacacccattttcacagtcactgaggagctctaagagttgattttgaaacgtagtggaaattaccttttttgggaaaataacataaatctgagataaattcttgactgtccgtactcaaaatatttttttccaaaatgaaaaaaatgcaaatgtcctcagcataataatctaggataagtagttaatgatgctacattaaggcattacttggggcttgcaaattcatgactgacatttgatgatatcccaggttagaagagttatttcctttctttctttcctttcttccctccttccttccttcctttctttctctttctttctttttctttctttctttccttctttttttatttctaaaggaatgtgtaaattaataacaaaaacctttaacatataaacagattgataaattactgagcaaaccaaactgtccacccatgtttttccttgtggtagtctgctccaaccataccagcaaggcctagaaagagcaaaaaaaaaaaaaaatgtatatatttggcggtgtgatattttcttaaacaaagatttttattgtaatgcctaactatttctctcatttgaatctgagttgcaatttagacacaaatcctgaggtcagatcctggcttatagctggatactatagagcatgtgctgtgttcctgactcctcatctatgatgtagaaatgataaatcccacagcagaatgttcaagtgaaaaagaaataggaaaatataacgtatcatgcataaggcctcttataaaaaacacagattccaaaatgacatggtgattatcatcattttattatagccaataaattgccagggattttaaaaactatcattctctaagaattctatttaagaacatacatatagataaaatatgcattcaagattttgtaacaggatctggaaataaagtcaacacaaaacttttctatcctgctgctggtattcaattttctattcttgaacagatattaattgtccacattccctactttctctctcaagtttacttaaaaaaatatctactgggattatctacatggtgccagacacccgtgaaggatagggtagtggagaaaataaacatgctcccgtttctatggtgtttatcatataatggaggacattcttggcttgtgcatttatttggttcagctatgtaagggatggtaaagggaatatgttcattacagaaacatattcttactttctctcctaattacagtaaatgttcagaggtatgggaatggtcaaacagaaaatggaaaattataataaaaaataagaaagttatccaagtccacagtaaaactatacaattttataacacagaccaagaaaatattcgcatagaatttggtatgctttccttgccccatcaaatccaccattttagtgctctatattctctttctgtttttaacatatgtaacggcggggctttctgagctggcttccttggagtgcagacattagtaatacagacaacttctattcctcttccccctacacattgcttgtaaatcagttattatttatttatatgtttttaattttttgaattatgacagagaaggagtagatgaatttaggtagaaagataggaaggaattgctgagccaaaactgaacaaagaaactggtcttgccatggggttagtctccaactcagaataaattgaatttttatatagagtgacttgtcagatcaggaggatagaaattaaagctagaagccctcaaaagttggagaatataatagaagattatacccaaattaagcagaaattcaggatctcctttcaggtatgtttgaatcaaaagcaaaccagggatttgcaacacaagatacacattgccttgggacgttcagctaccctcaaaccatgaattttgcttaagggtctcaggttggtaatatcactaacctgagtgtgacagagacaagtcaatcaatctctggaataaggcaatttcatcataggcttcagcttattcaaatcagttttcaaacatgatgggcagcatatactacaggttcaccaagcataggcagtgatttatctgtgaatgggaataaacagaaataacccattaagtttacagatattgaaatttgtagacacagtctacaaaaatactatgtttttagggaaaatggtaagtatataaactcaaacaagggactatgtattaggttatctaaaatatttaaaacagatcaaaggaaacttctataaataaaatctaaaaacctgaaaccataaagcctatgggtgaaattaacagtacattagaaggagatgaagatagaatgagcgagttagaagaaactcaaagaaattatacagaataaaacagaggaattaagagacaaggaggacagaatgaatggttaggctttatattgaatcagagtccttgaaaaaaaagaaaaaaggatgggttgaaataatgtttgaagaaatagtgcctgagaatattccagagctgaggaaagacacctgcactcagattcaatgattggaacaatttttcagtagtataaatacaaagaaatgttggtgattgtaaaactgcaaaacaccaaaatcaactgaaaatttttaatgtaaccttgaaaagaaagagaacataagaaattagcatgataggagaaatatttaaatcagtaattgatttctcatcaacagcaacgtaagatgaaagagaatgaaataacttcacaagctgaaacataataactgaatctaatgcttgaatttctttcacaattatattgtctaataatccaacaatcacattagaaattaaataggagcaagaatacttactgcagccttatttgtattgctaaaagcatagaaatagcatccaggtcaataagtaggcatttcgataataattatgagatagcagttcattgaaatgttgggcatccattagaaaggaaaaggcaattcttaaaaatccacgtggagttgtattccagatgtaatttttgcaagtgcatagccatttgcatacagaaaatgtatgtgtatgtgccgacacatgtatagattttgtggtaatctctggagagatactcaagaaaataattgtcgttgtggagagaaatgaggtgctgaagaaaagcagccaaggttggggggattcatactttttctaccccttgtaccttttaaatcttgtttcgcatgtactattattcatgaattacatatattttttaaggttggtttgattttagtttttaattaaaaacaactaaaatacaaatatctccacagttatcaacagcacagattaaggaatagtgttgtgaagtgtcttcattttaggggtgattgtgttaaagttctggggacttaaatgacctttttcataccatccaaataccgattgagaatgtaaatccaaatctctctacaaaatccatccttttatttttactgtttaatacctccacatattttttaaacagttctatacatttggtactatataagttgtattgccatcaaatgaatattcatgttcactccaacattcatacgtgtttttcaacctatggggtcctgggtagatgattaggtcatgagggcagagtcctcatgaatgaggtgagtgccctcatataggagaccccagaacactcccttgctgcgtccttccaccatgtgaaggcccagcaagaggaaggccatctatgaaccaggaagtgatccctctcctctccagacaccaagtgaccctgcaccttgatcttgggcctcgtaacttccagaatcttgaatgtatatctgtttataagccaaccagtctctggtattccattatagcggcccatacataccaaaagctgtggcactaacaaaatccagcaaagaagagttggatctaattgtttcattaaaatttgattatgaatctttgctacggcctaaacagcagagaccagagttctctccttccactgtgcgagcttacaaattggccgctaagagacaacaaatctaccagcaccttgatcttggaattcccagcctccagagctgtaagcaataaatttctgttgtttatcagccacccaatttatgctttttcattagaatggcccaaaacaagtaagaaaatcccccaaaacaaatcaagtgactggtacatgcctataggctcagtaatatttttttgaatgaataagtgaataaaggtagagtgaatgtgtattgcctttgaatgtaaacctttaataccaattgcagtatgatactgaattcacttaagaattatttttacatagttgtgtagaagcaatttataatatggaaatatttctcaaatttacagaaatttgataaatattatatttattttatgtaaattcccaaactaaaaagacatgtcttttctctcactgtccatgtaagttagtggaagacatcgatctcaaattacaatatttaactgtattaaattgtatatatagatgcagactctaggataaaagattaaatgtttgatatttttaagccagatcctattattaaaatcatcaatgatttttactgtgaaggtgtagccacatgacattaccttcagaaaacttcaaagcagcaaaagcatgtcgcagagccaaatgcagttcccagtgccaagaaaatagctaatatacatgggcatggttccaaaaaaacccatatggcaatgtgagttgaacatcttttacagcagcaattccattctaacccaagttctttcccttaaatagcacctcttttatttcctgtagtcaaactggctgtacagtcctcactcttgccaaagtccttgtctgggatgtgcatctccaggaaccgaagtgctaaacctttctttttactagcctgctctgccaaaatccatcttgacacaccttaaattatattagatcaaaggctgaaaattatatgccatcaaaagcagaaagataaaatgtttatctaccgcattagggatgtgcaatgtttttaaagcacttgatgtttgagtgagacattattcgacgtctctgcagtgcagcatggcttacttccttggagtagttgatagatatattgtaacaggctggtggcaaatatgaagtggcatattcagtatgtgtttaggatgtttatgtgttctctgattcttgtggtgctctgtctaattggaaataaggtttacgtggtgagagcagtgaagcaacgacagggcaatactataaaagcgactcctgccaccagcactccatttcttttaatggatttctacatatttggaaacttttctaatttctccttaaaaaataaacccataaatgtcaagaagaatgtttttcttcctaatggagtttgcttgccaagctggctttgttgcaatgtctgtaggtgggctacggtaaagaccagtggaattgaagtaatttttaaaggaatattgtctcaaatgaaatataaacaaggaactgtgtacccaggcttcaaagtgataaacagatgatgctataatcaagtaatttttaataaatatttgatggaatttactgaagtccatatttcagtaatccatcatccactcccagatatacattgagattacaaaattaacaatttgtgctgttgccagaattaaaatttcctagtaaagttgaactattatataaccttagtatttttgcatccttaattttttccagattattttgcaggctataaacatgttaacctttaggactattttatgtccaggtactacttaaaaatgtattttagatacaacaatcatacaatattttctaccgttatggtttcacagtagataactaaaattatatatatatatatattttttgagacaaattctcatgctgtcacccaggctggagtgcagtggtatgatctcggctcactgcaacctccacctccctggttcaagcgattctccttgattctcctgcctcagcctccagactagttaggattacaggcacctgccaccatgcctggctaactttcgtatttttaataaagacagggtttcgccatgttggccaggctttaacataattgattatgtttcaaaaaataagaagcaatttctgcatacaaatttcagaaaaattcacttggaaataagttttattagcttacactgtgggtagagaaaagtaaaacattgaaaaggtaactgtttgctttaacatttacctgtaaaaacattcatgaatttacctacaatttcttggaagtagaaatatattctcaatgttgttttagaagcacatatttaatggagaaatttgttttttatagtgttatttttaaacataatttttaatttagaaaattatgacaaaaactcgttcattcccttttttggaaaaacgatacttaaccactagtaaatgttaagtcctgcattatgcacaggggttaataaaatttaggatgacatggctcaggcttgtttaagacaaatagcactgataggctgttccataaaacttgttatattgcttggaagaaatgaggcccatatataattgaatatatcaaagttagtaaaaagacaaccaccacgtgtttatccagcccctgcaatatagtgcattctgtgctacactgtgaagatcgctaaccattatgaagattcttacagtcatgggatgacaagacttctgtaatgcaatgattacagcactgtgtgatgaatgctctggcctgtgtggataaaatgctttagaaacatgagagatacctgcaaaaggtagctagtaaaagcttcagagaagataggacttctgaatttgggtcttaacattctaaaaaaagaaatagtttgaccaaagacatggaaatttatttgaatttgacatattttgtttgcttgtttgtttgtttgacagagatagggtttctccatgttgctcaggttagtcttgaactcctgagcaatctgcctgtcttggcctcccaaagtgctgggattataggtgtgagccaccatgcatggtcttgaatttgacatattttgatatttgggtaaggggagaagattagtgcaatggtttgcacattggaccgctccaaacctcatgctaaaatttgatccccagtgttggaggtggggcctagtgggaggtgtttgggtcatgagggtggattcttcatgaatgacttggtcccaccctggccttaatgagtgaattctcacaatgtcagttcttggaagtgatggttgttaaaaagagcctggcacctcacccctctctcttgcattctctctgcacacatcagcttcccttcgccttccaccatcattgtaggtttcctgagatcctcaccagaggcagatgctggtatgcttcttgtacagcctgcagaactgtgagccaaataaacctctttcctttgtaaattacccaggctcatgtatttctttattgaaacataaatggactaaaacatttgatgtggttgaagtgtaagttttatggaagagattgccaaggatgtgtccaaatggggtggtgggtaaaagactttgaacgttttccaaatgtatgccaatacatctagactttacttttgagctagaggaagaacaggtgcagccaaaattaattggaaaagtgatagattgcattttgtttgagaaggataattctgctattaaaagagtagattgcaatagagagagtcaagaagacaccagtttcagtggtcattgtgaaagaggacttggtttcatggagctgggggaaagaggtcagagaccatgggcaggattttgtggtcaacttgacatcgggatgatgtacaaagaaaaggcaaagaggaacaatctgggcagtgatgtcagtcgaaatttgggcagatcgttttgatagaatggatcaartggaatccaaataaagtaaaattctcaattatgagaattcaattaaataattttgctttaaaggaaactaagatttttaaatgccaaagataaaagctgaaagtcattataactttagtcttccctaaaagtgacttaagcaagaaaaaaaaacagtatatttttgaaactagttaacagggtatttggcttaatttaaatgatctctccagcagatattccttttgtggtccataaattttcagttgtttatttatttttggaccatacagtaaagggttggacagagataaaaatcagggaaaaggaaagtccagacacagaaaccgctgagtgggcagaagcactgtccgagatcaggggggcacaatgatggaagtgcagytaaggttgtttccacgctgtcctagatgtacagagccaagagggtgagtctctcaaagccacagttgagaaggaggtcacttgagtagcaggagagaaatgctggcaagagaactgggccacaaacacagtccaaagggagatcacggaagcccatgaggaaagtcaggaaggagttactgcaactcaatagctgctatcataaaaacaaccctgctgctacgtgggagctggtgtcttcctgtaaaatatactccacctaattatcctacagcaagatactgcatcagtgcattcccattgccttgtaagtccgccttgccttgtcttgccttgccaagggtgtgatccaaaactgagtgggctgatatgaattgggtggtgctttcrattccctacatagtttgcctcctgaaaacctcctttggtatttgggccacggtaatgcaaaggagccattcatccaggtaaattggagctggaggtaggggctgagcctcttctggggcctcrgggggcttcatcatgggtcctggcctgagtgcaaagatagcatctagtatcacagataacttctttttgatgcctagccatatttctgattttcttgtttattaagagtgagaactacatttcctactaggctaggtcttacttcgcagttcttaaaatgtgttaaacctatttgtggttctcctttgaattcttcccaagttctctccacgcctgggaagttgtggagctggtcctctagagatgctatgtctatgatgccaacccaattacaaaacacaagcaaaaacaaacagctacgctagactttccaaactctaaaacatcraatctcctctttgaccctatcatgaaagtgagttacttaaattaaagagtaattgatttgctgttaaatacattatttgccaaataatttgactgtataatcccagtgtagttataattctgtgtggctaaccctgtgttgctctggaattctgtcctctgattttatgaattctaagatgctgatttaatttaattttttaaaatatcttccagtttacttgagtccaagtaggctgatccacagaatcatattcaaagaattccaatgagctgttgaggaggattttaagccctccactagcttcctggcatcagttggctttgagaaccaacctaagtatttcagagctgctagtgaaatgaatctttcttacagatattacagagggttacagaaagttcagtttctgactcaccctgattttgagaaactgtttcttagggtcattccctaaggttggaatcgctctctctctctctgttggttagtgccctgtaaacactgacaattttctttctcttcagttcttcattcttggtctagtgcttcagtttccaagtctacatgactatgctacagtgtaaggttatttagacgtacaatttcatgatttctttcttctgggattatttgcttgacttgtgattagcttgcctgatcacagacaatagtaactttttaaccattcttacatgatttcccttttccttaaatttgttgtttctgtattagaagcaggaaaaaagggccaacgtttagaatttgaaaagcagtgtttgaatgcacttgttacctggtaaaccagtcatttactgctatcttacaaatgaccacagcacatggtagacttaaagaacaattatttgcacatttctcaattttgtggrtcagaaactggcagcactcagctgagagactcttctgttttacggggattcacagcgttcactcagagacagatagctggtgggcaggccggtgtcagggaccaaggatggcatcactcgtgtgtctggcccttgacagggatgctggaggtctgggctcacctgggaatggagatggcaacacctacatgtgacctytccagcatggcagtctcagagtggatatggcaacagctgcacatgacctctccagcatggcagtctcagagtggatatggcaacagctgcacatgacctctccggcatggcagtctcagantggagatggcaacacctacatgtgacctctccagcatggcagtctcagagtggatatggcaacacctacacacgacctctccggcatggcagtctcagagtggatatggcaacagctgcacatgacctctccggcatggcagtctcagagtggatatggcaacagctacacatgacctcaccagcatggcagtctcaggttactggtacttcttaggtctcagctgaggactccagtgcaggtgttgcaagacagcagacgtagcactgcttatgtgtatcctgaagtcccatgtgtatcctgaagtcccagaaagctgcttcaagtagattccagtggagaagggagtcaccaaggctggacagtcatttatccatggcaggactagcaaaaaaatctgcaccatctctcatcgcacacacgtgggtaaggtttggactggtatgatctttttccataatctcattttcgtgatttcttaactgagaatataatagtaaataccaatctcacagaattgttatgaggaatgcagaaacttaatcaaattacttaattgttattttcatttcttattaatttgttcccattgaaattaatgttatgtctggtctcattttaaattatttatckttctgaatttggatcccatcctcaagttttcaatgcttgactttttatgaattcttgtattatacctcaaatttaataaaatccttttaatcttgtcttcaccctagcactgtctatactgtcccctgggtggaagtttcccatcattctaattacttttrtacacaaatttgacttctctctccagcccctgtgagaaacatgtcctttctgttacacagggagtaggtgaaggcctttggacttcctatttttcctatatgaaactctcttctttcagatatcagaattttcctctctctctttcattcagaactctgctagacaatcatcttaccagraagatttttattcatcaccctgtgctaaataacattggtactatgctgggctgagctactatttttccttgaatcctgctgtaggcttttcttcagacacttaccatcaccaggcgtaatgtgaatgtgtttgttcattgcatgtcttctccacgtgaatggaaacttcatgacaagaatgtgttccagggctgggcgccgcggctcacgtctggaatcccagcacattgggaggccgaggcgggcggatcacaaggtcaggagctcaagaccagcctgaccaatgtagtgaaaccccgtctctactaaaaatacaaaaattagcctggcttctgtaatcccagctactcggaggctgaggcaggagaattgcttgaaccctagaggtggaggttgcagtgagccgagatcactcaagaaaaaaaaaaagaaaagaatgttttccttcacctctgaatccctagtgtataggggagagcctggaacagagtaggggttccataagccaatcaaataaatgactgaaaaagagttaagggacaaggtcaaacaaaaagagctaatttaactgctaaacgattattctatttaggccaattggtaacccatgactgcttgtaaaattcaatttcattgaatgggacatatttcaaacataaacataggtttttttaatgaatataactgaactgcagattgcaatcaagatgttccctccctttctcatttagatttctcatcttattagccatcactgaccctcctctagtggttaaatgcttagtttgggacattatctcagccataccctcagaatggttgattcagtggttcgttgcccatgtgtgctgtgatgtcaacaggctgttgaatgctgagggcaatctcatatttggctaatgatggttcttcagaaagcaacacccttcagattagttcagcagggttcaactttgtggtgaccacagttgggctgagcaggctgcatgtcaggcagagctgtcagtctgctccagccaagagtggagtgggcacttcttgggatttggataaggaaacatttgtctgagcagttttaccaccttaatatgggtttgattcttctatttgtatacagagtaagccaaattaaaaaatgaaaagaaaaaagaaccagttcatttaatcaagacatgctagtggttagtcatcttttataacaaccacatcgataattcacctttttcattttcaaattagtttttggttgttttgtagacagagagccttagccataaattaaaagtaatgataattagccacatgttcttcattatgttgagggctttgaacatttcttcacatagctattagacatgtcagccacatgtaggaaaaggaactatagaatttcgtaattttttttttttttggaaaaatgagcaacagaattttaaggcagaaacgtgaaatgcgagtgatggcaagtcccagtgaagtggagaatagcatgctttatgtgaatgtctgatatttgttttctcagtgcttttgatctcagaacacctaacaggactggggcagaagctttttgctgacttgttgcatcagtgctaaagatgaaaggaaacagtcttcatattcgccgtggtgttgattgccctataaataggaaactacccagttaaccttgcctgttgtcatacggagagttttattaaaaaataaacagtgcgtggcgggtagcagaatgtgggatttctgcttagatgcccgcaattctttcatatacttcattaaaatgtgcaggagaacttcagagccatgaataaaaatattgttatggaaactgaggcctgttatcatagcttcagtgatttgcaatgattatttaatgaatgagtttatgtttgaaaatatcccctgtgataatatgaatttatcgctcccccctacccctccgatttcttttattttgacacatatggaagatgctgttttgttttgacactcagaggagatgctctttttatcaaaaatcactgaacagtaatgagattttagtgaacaatcttaccagacttcccgaacataaagaaatctgatactgaggagtgcacagtgttctataataagtaatcttaggtgtgtgcatgcttttcagtggcagtattcatttttcacgagttttgtatttgatcttaccaggatttgatgtaagaagacttgggtagctcttgtgtagacacaaagaacagagaggacatccataaagccatagagacaggatcccaaccacagtgtgaggagaaactgatgactatgccaggcatacagcaccatctcttcagcctaagagcagggggtttaccaagctcaccaaaacaacttaccattcctctttccgcgtgattggaactcatcttcctcctcagagggtgcagagatgaatttagaaggaagtttgaagagcccatggtgtccagaactcaggcctgcttgcaaatgagtggctctgggactgtctttccacatctccaggagcctattttccgggaggaaaatgagagcactgttcagaagtactggaaggaacctgccaacattgagtttcttgagagtctctgaagttagttcttctaatttttagtaccctgacaatttcatgcaagttagtaacttttgcatacttcagtkttctcatctgtaaaattggggtaatgataatatctaccaccctcacagacacacccaggattaatactttgcatccttcaatccaatcaagttgatactcagtattaactatcacatggtccctgaaaattttattttattctgatttgggaataaaaaagctttctctttgaccccgaaagtttttctctttttgttaaaatatattaaaatatttatatggatttctaaaatattgtgagccccaggaactctggttaatgtgcctgatgatctctgttgccgtcagggttggtttctcattagggcacttctgggcttgtagagggccactttctcaccgtgtcccagaatggaccttccaagatctctggtctcctttcctcttaaaaggacaccagtcctatcagattagagtccctctcttatgacttcatttagccttaattatcgccttaaaggccctatctccaattgcctttggggctaggaaatcaacatatgaatcttagagggacacaattaactcaataacagtgacattttaaaaactacaaaataagggaaatatcatagtttttttctttactttcacatagatattacatcatattaaaagatagatcatttcttcattttaattgaaaccagaattatattggaataaggggtgaccaatatgggtttttcaacatttactcttatattaatgtattagcagaagacaagagttcgatatttcttaataattttcctagaaattgactaatatttttatttttactttctcagatatattcgttttaataaactatttttgttgttatctaatagtattcaatttagacaatttggagaacatggatgcctataaacatacataagaatacaaatgtatcctgctttcagcatcagagataatttagggttattgcaattgtttctgttttggcaaattggaaggattatggttgatgaactgaggtaagtattctaggaagaatatttgctgttgggtcaggcatgctttcagtttttatgtatgtagagtttgatagaccactgagacatttaaaagatgttcagaaggtattgaacttttggaaaggcagatcaaaatcccacaagggaagcctgacctgtgtacagacatttgtgaattgtctgcatataggtggtattgaagccatggatgaaattgctaactaaagcatactcttgtgagaaaagaagaggacaacttacccatcgggcacattaaccacagttcctggggctcacaatattttagaaatccatataaatattttaatatattttaacaaaaagaaaaagaaaaactttcagggtcaaagagaaagcttttttattctcaaatcaaaataaaattaaattttcagaaaccatgtgatagttaatactgagtgtcaacttgattggattgaaggatgcaaagtattgatcctgactgtgtctgtgagggtgtagccaaaggagattgacattgagtcagtggactcagaaaggcagacccacccttaatctggctgggcaccatctaatcagctgtcagcatggccaggatattaagcaggcagaacaacgtgaaaagcctagactggcctagcctcccagcctacatctctctcatgctgaaggcttcctgccctcaaacatcggactccaagttcatcatctttgggacttggactggctctcctttctcctcaacttgcagatgccctattgtgggaccttgggatcgtgtgagttcatacttaaatacttaataaactcctatatacatatatatatatatatatatatacatatatatatatatatatatctaccatattcgttctgtcactctagagaactctaatacatacaataaaaatctattaaatttttgtctgaaacagaaaaaataaaatatttaacctttaaaaatgttcaatgttgatatcaatatgatgccagagcccaatgaaaacaaaagtacttagttcccacaaaagttataatgagaccctgatttgacctagtttggaaatagcaacctttaaaaggtttgagaaaaataaatacctacacaagtgtttgaaaatatcccaggtgtctaacaactcactttctctatgtctttcccataccccaaatatcaaccatgacatttttccgctgatctttcagatctcagaaggcgacatgaaggagatccctctgctgtgagattgctattttcctattgtacctcaattacatttataaacttctttctttcatgccagcctaagtggtttttgaatttattaactttaatgtttaataaaccagtttctatagcaacaatcctatgacagatgttttgttaaagtctctttaaagcacacacctctgtcaatatgttattttgaacatttcaaaggataaactcttgaaaaaggctgcacatatctcaactttcaagctcacaatttgcattaataattataccctctcttaataaaagaattatttaatagaaggctgatgagctaattttaagaataatacagtaaaaggtcaaaataaaacttaccactctcgagaagaaagtgtaaggtcaagaaataaaaaaaaattacaacatggactatactactttcctcaatgttaattactttaataaatgtgtgacgaatgattaccaacattttaaaatctatgtgcatttttctccaatgagtggcactggttttctttgcacttttagagtgctcagtcctggcatatgtaggtcactgaccgggaaattaccatctcaattcactttctttcttctttgctatttcttatctgatctcgaagttaaggcattgaaactattgcaaaaccctcattattttttcccaaattaaaatggtaatatttaatagctgcatattttgatgcatgcttttggctctggtttcctttttttatgtgtttttttttattgttgttgttatgaagggkttttttttattgcttttttgttaaagaacgtagcaaaaaaaatgaagtatactaaaagctatttcacccagagaaacataatttgttgggtttttaaaaatatcattttcatctgcttctttgggaaacatcagaaataggcactgagggatggcaaggtttatgctgaactctaagtaatgcatgttgtcacttgcagccagtcactgaactttctctgccgtagcttcctcatttttaatgtggactaagactccacttttatatcaccacgtccaagtttagacacgtgaccctaagttgctctatcagggatctctaggccttccctatgtgagacacaaggtgggtatggactgcagtcaaaggcaagtgaggtttttttttgtttttttgtttgtttgttcattttttgagatggagtctcgctctttcaccaaggctggagtacagtggcgtgatctcagctcactgcaaacttcgcctctgggttcaagtgattcccctgcctcggcttcctgagtagctgggattataggtgcatgacatcatgcactgctaatttttgtatttttagtagagacggggtttcaccatgttggtcaggctggtcttgaactcctgaccttgcgatccacccgccttggcctcccaaagtgctgggattacaggtgtgagtcaccgcgcccggctgcaagtgagtttttaatgaatgcatggacttgaggacagaagaggagcccgaggtttctagtgggggctatgcacagttctgtgggttaaaggttgttcttcctctttccctgagctggggagctagggcaagctatgtcttatgtctcccaagagtcaaaacctttggctccttctaaataccagcctagctcatactaacactggatgaatacatttccacaacagaaactcaaaatccatctgtttaaggatgcatgacaaatttcatttagaacaacagtatgagagtcatattcaaatgtgaagcaagagtgagcacaaggctcttatttgttccttaagaaaaaaaaatttatttcttagtgagtttaaatcatcaaccatgcttcaggaagaaaaatgtagcctggcctcctttccatctctttgtgattgtggaaaagtggacctttaagatttcactgaaagattacagacctgctcattaattttacattccaaacctttgactggtgataaaatgaacaaaagaatttaaaataaaggtggaaaaaaatggatcccttttcatccgtgagggccctcaggctatatacaaacacaatacacaaaacctgcatcatttacctgggacaatgttatgggctactaagtcgatccttttagaagagcagtgagttaatggattgttttcctgacaatatttgtagtacagtaaaaaataaaatggggaaaatatttttatctggcttttaaatgttatgttttatggttgggttaatgttgtggctgatcagctgttacatggtgcatgaatattgactggattctccattagggctgatggggcatcaccgaccagctatgtgatctatgttctcccactggctcttgcttggcatgagagatacatttgcaggatgaggagcaggaatgagagctatcgattgtagaaacagaatatagtagagctgattgacctgtttcaaaattaagaaatctgttgccatatcttgcattacactcttttattttatattcttactctgaattccttcatgaaatgcacaaactccaccctgtatatacatatatatatatgtttgcatttcctagcttttaaaaatagtttaaagtataccttctccaaaggggaaatactttgaaatatttttggaagagaaattgtattagtttagatccataataaataattatattgttttaaaagctggtgcaaagtaacattttcttatattgtagaactctaagccttttggcttagaaaatgagagcaatattcttctgcttttcatcacttacagggatattcttggtattattatataaattttattttcattaaatataccataaaattccaaatgtgtgtttcgaattactggcagaaaaatgttggtaattttttccagtgtgacttaactgtcattataattaagtaattgtctccaccaaaatgtttgtttaggcaatacatttctgcatatttgaaaacctaataaaaagttttattaaagctgttcactcaaaaatagacaactgtgccccgctgagcagtagtttaaaaccaaatcaatgaatttgctattatgtagacaagaaagtgtcctatcattgacattagtaatgtttccaccaagttgaacgtgatgagggagctgttagttgttaccctggaaactattcaaaaggtctagagctgctgaaaaacagaagactctgggctcacccctgggattccgctgcctttcagaccatctaggatccaaattttgggaatgtattctgtatgtctgaacatgctttactgccattttagactgattgtatctaattttaagtttatgatgccacctctctttttccctatatttctaaactttctggaagacgttctgaaatcattcaagtttattctcattttttatatctcaggactagtcactcaatctttaaataaccacttttgatcaagagattactgtacccttctgatacaacttaagatcataaaaacaagttgatccaattcaatagctttttcttatattataattcatgccctggccgaataattccaactttttctttttttgaaatatatgttaggttttcctggttctcaatcaatctacgtgagcactcattctttctgtattctggttcctactacatcttttatcagtgtctctttttgcattcattgatcagtatctctttttttaaatgcagaaaaaatagagtgtgcttataaatgtttaactattagccagctatttaacttcctaacactatctgatatgcttgttattaaatccaactcattttctatgcctttgattcgccttatacactactaaggacagaagagcaatggagtcgatctaaaaccagagaaccagaatcccttactcccacagagagattgcctgtgggctttaggcatcggtttacttgtctctagagctcaagttcacaagcaccagtagccccatgggtagaatgtgaacctctgttctatacagcatgttgatgaatgcattacttctgccttagtcatgtcggagcacagtaaatgtcaactagcagtgcagcaccggaacacgacatgcaatctgctcacctgagtcatgctgctttcagaagagaaggcactggtttaaatctgcatggcaagcctgcccgagctagaattcgatgagaaccctcaggttaatagctttgctctttgagagagctctaagctcttttcattccagaccaatttcacatttacatactacctgtcactaaagccccaaggtccttcgccaacaagaagcagatatttactcactaaagttaatgtcccagcgctttctagcctttggacacagtttttaggcaacaaggaaaataatacatatgtataaatggccatttgtgttcctaaaatagcaaggggctataacccaaagcctagaattctttttcgtttttttttttgttgttgttgttgtttgtttgttttgttttgttttgaaacagtcttactttgtggtccagactggagtgcaatggtgcaacctaggctcactgcaaactcagcctccctggttcaagtgattctcctgcctcaccctcctgggaacctgcaattacaggcgccagtcaccatgcccggccagtttttgtatttttagtagggatggggtttcaccctgtcgttcaagttggtctcgaactcctgacctcaggtgatccatcgtcttggcctcccaaagtgctaggattacaggtgtgagccaccacgcccggccctagaattctttttcttaaagacaattataatggtaattccgtttaaaatgtcactataaatctatttcatttattactgcatgattttaatctattattccacttaaaagaaaaacaaatcagagaaatcagcaagggggcaataacaaatgtgggttagggtacacagcccactttgggaccatattcaatgaagaataagatgagagaaagataatgtgatttcttttattattattattattattatactttaatttctgggatacgtgtgcagaatatgcaggtttgttacataggtatacacgtgccgtggtggtttgctgcacccatcatcctgtcatctacattaagtatttctcctaatgctatccttgccctagtcccccaccccccgacaggccccagtgtgtgatgttcccctccctgtgtccttgtgttctcattgttcaactcccacctgtgagtgagaacatgtggtgtttggttttctgttcctgtgttagtttgctgagaatgatggtttccaacccggatgaagcttgatttattaagaccaatagtaattacagagtgtgccgtccatgagtgagttaggatgttttctgtgacatgtgagagaaagcccaattcaatcttccttaagcataaaaagatactttattggcatgtatgagtaacagttcaggagtagatcctcaagagtggcttatctaaggcctcaaagatcataatcagagtctaatttaactcatattatatgtattgattaagcttcatctatgtaagctctatacttaagctccagttcctactcagaaagagggtgacacttcctgatggacataactgaaaccccagaatggggtcacaaaagccccgagttagactaacttgtgaaagagcccaccttagaaccaatcatgatgcccaaagacttggaaagtgctgattttgaagccccatcatcgaagcagtgaaaaggaggcccggcatgactggccccattttgctcctaagcccacctttaggtaaacggcttttgcttatctctgcatgtaggccaagctggctacgggtggaatttggtttatagtttcactttaaagcaaggtttgtaataattccttcccaaaactaaccacggaggaaacaagaagggcgtacacataattaagaacattaggttaaagattataagagcattgtgacctgaccaaggatgaagaacttcacagtccactccattggaccctcattgctgcccagatatatgtggtcattggttgcctcgtgatttcaactccttccctctttcctcttccccaaacttaaatgttcctaaaattctattaggatggttctttaggacactaatcttccatcttctcagtttgcttgtcctccaaaataaagtcagcttccttgctgcaacatcttgtctcttgacttatttgctgttgtgtggcaagcagtatgggctttgaactcagctacatgtctccaagtctgtgaaaatgatgtcctcttagagtccttctgttcacacctgtctccatctcccggggctggagatgtagtcagcttgacctatgcagaggagatggtgcgttccctcaagccatatgtgaatttcctgttgccataagaagattgatcctggggctaacaaaacatcaaagcctattatagataatatttaattaaatctatggatacttctagttccgttagcttccagccaattgtcaatgccacttcataaaaattaagacaggagcacatttttggagcacttagtatagactagatcttatgttaaattatttagactaggcagacatttatcatagcagttgtgtaagtaattataattgtgtcttcttagagctgaggaaacatataccaaaaaattttaagtaatattgacaaacccacatagccagtgagaggagaagcaggagcttagaaacaagcttgtctgactccagagactgcagctttgcttataaagacagaatagagaatgttgcttgaaaacataggttcaaatatatgtttcaccacttagtagccattcttctttgaattctccacctagatttgggatattttcttctatagctaatgcctaaacacttaaaagtattgttcttttaaggacaggcaccttcagagcctgtcagaagttgcgatcaaatttcttccttagtcctacaatttctattagcctctttttctatgtcagttactctggagtttacttaagtcaatcaaccttcacttcaaaacttcttccctggaatctttttccttttcctttcatttagcttagctcaaagtctatgcagtcttttttttcttttttttgagacggagtctcgctctgtcacccaggctggagtgcagtggcgcgatctcggctcactgcaagctccgcctccggggttcacgccgttctcctattctcctgcctcaacctcccgagaagctgggactacaggcgaccaccaccacgcctggctaattttttgtatttttagtagagacggggtttcaccttgttagccaggatggcctcgatcttctgaccttctgatccgcccgcctcagcctccctaagcaggggtgtctttatttatttatttatttgttcattttattttattgttttttgagaaagagtcttgctctgtcgcccaggctggagtgcagtggcgtgatctcagctcactgcaacctccacctcccaggttcaagcgattctcccacttcagcctcccgagtagctgggattacaggtgcccgccaccatgtctggctaatttttgtatttttagtagagatgacctttcatcatgctggacatgctggcctcacgacctcctgacctcaggtgatctgcccacctcggcctcccaaagtgctgggattacaggcgtgagccgctgcgtccggccaaagcagggatgtctttaatgccgcatcttcagtgcctaccatagagcccggcatgcaatagaagtgtgcgctaactcttccacttatccctgggttaggcccaactcctccagctatagtagtagagtcaaggagatcccagaaaaatctgttttctctgcacccaggcttttaagtcatcatgagcaagactctgccttttcttagtttttccaggtggtgaagatgtggaacaggaaaaaccacataaaaatgcaatcacatgaataaatattgcctacaatggctggattcaactgaagaacttacactctaaatcaggagcacagactcatgtttatgcctttgtcccaggcaccaacttctcttgaacttctttgctgaccctgcctgaaagtggagttaactaaatcttgtgtagatctgtctcatatcactatttagcccatttgcagataggtatgatattgttaaaatgatgaaaatgccccacgttggactcagttggatattctgctccggcagatcaggttctaactggaatcttggttcacttcacttttgtaggctaagatattctattcgtacttgactgagcattgtattgatgatccctgataatgcagctcttcaaatgtaataaatttcttttgtaattgactggccatgcccactcaagagatatatgtttgttgcctgattgagtgtctaagtaaagaattaaatgaataaatgaaagagtaacataagaaataaacaacactgggacaatgaactgagacttcatttattaagaagcaattattgataattttgtatatgattttagactataactaatatactccaaatgcaatagtagacaagatagaaatggtcccttccttcatactcgtggttgaaatacattgtattgctgatgttccatagcttttttacacatgttgttttcatttgtttcaactaacggtaaggagtgtggatatttgaatcggccagtgcaaaatgcagtgacttggaaagagggaatcactgttagtgaatcataaacaatatttgaaggtccttcagtggtttattaacttcaaataatataactagatgagtctcggttttacaagtaaccaggaagtaatgcaagaatcctagcgagggtggtatcaaaaacataaagtttatgtataaaaagcatttgaactcaagaatttgacatagaccttagtgaaaatgcagctatttcttgtcagtttaaaagaaataaataatttgttaaattcaaagcaagggatccctaatcaacttagctcacaggtaatttcaaataaacataatgcttattaacagttccaatatttgactttttgctcaacctaaattcagcaatgcaatgtgctgagatatatcccagtaaagagcagctgcttttgttttgttttattttgttttaatttatttcacaaacaagtttctgcatgagcctgaatctttacaatgtgaaagctgtttggattcaggtaggaaatacgtttgaactgatgcataccaaatttccaaaagttcacctttttatcttactgcttagctgttgaataacacaacttttgcttagtcaagccttctttcattttcttgaagatgaaaatgtaattcttgagttacttctgaagaacaggttggggaaatgcaaataagagcattactcttctagagtatgaaaagattaccaaatttaggttttctggtcagtaaaattatattttcctaacttgtttactaattacagagtcatttaattagattatcatttcttctttttccattgccatctttttaaatgatgatatttccagaactgctctatttaactgttcagtgaaattacattcatgaagctgacaattattcagaagtaagtttcctatgtaactctcccattcttcatattctttgtttctaatttatatttgggtctgaaaattgataaagttactagtttagaaataattaactgtgacttcttattttcagaaacataaatgagggtgcacttctccgcagaacctttttcacattcttttaacaaccaaatcattcccaattttctggtgtgtaaattccatgtgatcagtacaaataaacaaactgacaagatttgggcagttggaacccattgttttacaacgtctttgtttaaaatctttcataattcatcttcagcaatggccttcctagcaattagttacctttagtgtcttcattttcgtttaaatgttcaatgatcaggataattagaattaatttctcattgtcattttatggtaatgaagcttctgccacttatcacaagcatcctgcaggcacagtgttaccacacaaatatgtgactcctcactcttcacacactggtttatggtccctggttaaagtggtaacagtaggacctggcctgattccagtttaaatgtatgccatattagatgaaagattgtgggtagtcatgctggtattcttgccccttgtggatggcattctatgtgcaactcagttctccttaagcaacacaagagaattttcgtctccattagtctgggtgttttacagactgggattagttctacagttagaacaaaaggaaatatctttgtgaatgaagatggaaggcaatgtcaattcaaaactttataaaaacttcagatagaattcaggaaagcaaaggttgaaaaacttagtaccagaaaatctatgaagaagaaagtgagtcagtgaattctcaagctggaagagccttcttgcattatctggtctaggattctccagccacaaaaaaaaaaaaaaagtaattgtgtattatcatccccattcattccctgtcatatctctgcctaagcaattgcagtagaattcatcctatcatttgtatcctcttccttactcctgggaaacatttagatagggtaaaggatttggttgagcagaaacctggggtgggaaatagggagcatatctaggtttgtcaaagaaggtatttaaggctgccctgtgaaatcataccagtttcaaaattagaaacttgatcttttttacagctgacttttcttcaccacattttaaacttgttctttattctgcattttctcaagaagggatatgatattaccaagagaaatacttgctctcaataaccccaacctcattttcttatgagtttgggtaagttagaaagaaggtcaaacttagtagcttaaagaaaaaaacacattttcttttgcttataattgttgaggaaggaaattggaaagggctaggcagggcagaattggaagttttcctgtgtgtctggcagatgttggctagtgctgcaattatgtggagtctatttaaactggccatcctatggcttcttcatgtggctggtggtgaatggtggctgttggctgggaactcagccggggatgacaagtggatcacctccatgtgtctttgtagcacagcagtttcaggcttttagaatttcttccagtggctggcatatacctgaaagaatgtcccaagagagtctaaggcagaaatgtgtggcttatttataactagttttggaagttacaatgagacatttctgctgcagtttactgatcacaagagagttactaagattgatcgagtctctacccatgtgagggaggtgaatcaaagaacttgttggacaggttttagacctgtcatagagtgtaaaaaagctaagaggcttcatattcaagggaagaaatactttaaagttctccagggatgaggctagtagtgatgattcagggcaagaccagtgaagtaagagaggctgggacatgcattgaagaagctcactgagaaagttctctggtaatgggctgcaatgtgctggagttagtccacaatggcttgcaagatccagttactcacttgttttctcaattccagctctgagttcagtgatgtcattgatagtttgaaaatgactacagtggaatatttacaccacattaattggcagactctacaaataagggtgttttttccccaggagacccagttgctgaatagttaccaattggtaatggggcaacttagaaactacttttaggagaactggactgtctcatagcaattctatgttgtgaactttggggttaaaaccactctgcttttgtaaccttttcagtaaaatttgcgaggttccctattgcttttgggtgaatgacattttgggggataatctaatgtgattctgaatttgagtcaacactggctgtttcagaacagcacatgttgaagcaggagcctgatgcagaatacgtcattagagggaaagtgctggtaattagcagaaattacaggaagctctgtacttcaaagactttaaaattgagtgtgtgaaccaagcacatttgagtttccagagaaggaatgaagctccagttgacactttggttatacaactgcatgataatttatcatttacagtatacttttatgtacctcataatgtttaaatgggttatagatcaaatgcaaatatttaaatattttgcatgacattggacaagtcacttaaattttctgatactcagattcttcatctctaggaattagctgaaagtatctttatagagagttgtttcagtgagtgctgtaagattaaaaagaaaaataagagaccatcattagccatgagtttagtaaatatttcccagtggtggaacaccaattccaagtttatgtaagttggtgttgatgggaaataagcaatgattaaacaaaggaaaatcaggagaaagattgttaacaaagggcaatgctgtataagtgcaaaaaaaaaggggaaaaccacagttttttgatttcacaaggaagcagagggctggctttcattcatgccccactccagcctcagttccattgcttcttgccggcaaagctttctcgctctgacagaaggcaagcaaaccccaagaggccccaaggtggcctgtcagagggggtaaaatatatagttttgcaattgtataatattaatgttcttatcagagtgagaatgtgagtagaaagcagagattttaataatatgacccaaggaagtcaattttgaacattttacagtattaacaaaaatgtttagaactttagaatatatttaactcaataaaaaataaatatattttatgttatgtatgaataacataaacaaatgtttggattagttcagagttgatattttaaaataataaatgttttgttctagtccatttaattatgggtcttgattggcaattctggaaaggactcagaaagtaaaaaaggagagtagggaaagcctcaagcttagataccacctaagtcatcattaatagctattggtagaaatatgggtggtgaagaccattctgatgtgttcccagatcctactggggagaatgggattggaaaatggagaaaagtctatctttgttatgaagtgtcacataacttggctgagttgtgttcctgtcctgatattttggggaaggtagaacttgtgagtgatgaaattgtatatttggctgcagcactttctaaacaacactttgaaagagtagcctccttcctctttgctgctcctagtaaaatgggagaagagaaaaattattagaggatggaattgttaatcaaaaggaaagcaaaacttaaatatctggaaaattcttagtctatccatattgtaaaaaatgaggaagtatctttgcaagagaagaccaagggtgtgaccaaaggacaatctaacagaattactcagtcatttaacagaatctagaacctgttgtccnagaccatggaaggataatcctaaaagcaattcaaaaactatcagaactgccacccctatcgcagacccaaaatgcaaaagtcggggcagcagggtggtttccaatttaaagaagggaccaccacgaccccgtgctgcttcacattgtggatctacctcccttactctgttaccatgcaccttggtagccccagattcagttctggtgaactctggcagggaattgttaggggggcagagccaccacagtgaacttctaataggccaatgcccagcagagccacaagagtagggctgcccctgagacctcagacctggagagccacgggcataaaattcttggctggaagatccacaggcacacatctccaatccatgagagctgcattgtaagttgcatctggcaaagtcatgtagccaggggttcccagagccttggaggtccaaactctggggggcaaagctaagggagtaccacccagggtgctcagaagggacttttccccaaagtgggttggaagggcagagcatcaaaccgaagaagattgttattgagacttatgctataatgttttctctgttgggctgtggacttagggcctctttcccctttcctctttcctgtttctatgttttagaatggggatgcatgttctgtgcctgtcccatcattgtattttggaagcacataacttgtttgatttcataggttcacagctagggaacaatttgcctcaaaatgaatcttaccttgagtctcattcatacctaacttagatgatatttagatgagattttggactttgaactattgagttgatgttggaccaagttaagacttttggggctactgggatggaacgaatgtccttgcttgtgagaaagacatgaattttgagggctagggacagaatgctgtggtctgaatgttcatgtcccctcaaaatatgtataaaaatttgattttccaaagtgatagtattaagtggtggggcttttagaaggtgattatggtggagccctcatgaatgggattactgcacttacaaaagaagcccaaggaaaacccctttctccttccaacatgggaagatgtaggtgaaatatgacatgcttttctgtgaacctaggtaaggatccacaccagactccaaatttcctggtgccttgatcgcaaaccttttagcctccagaactataagaaataaatttctgtttttaatgaagctgtgcaatttatgatacttggttatagcagccagaagagtccaagacgtggtcctacaatgaagttagagaatttttttaagtgtctgtttattgttacaaatggcaaacaaaaggtcattatgcttacacacacaataaatgtgtacaatgtgtatgagtaagtttaaaacaacaattttttttaatatgaaagtcccagttagttttaaaagaaaatgaacaactgagagtaataaaacctttgttcttgttttgacagtgatggggaagggttttcaaaaataatgagttggcttcagtttggaattagggaattacctaccataaaactgtcttttagatatcctaaaatatcatctgttttgagatacacaacatctaaaggccaatgactttattttcctgcacagagaaaggagacctaagaaggattattttaggtttggattcagaaatggccattgtgtaaagtatgtgagagcagatttgaatatttgccatagtgcagaaataattgcttatagtacctgatttttttaagttattatttcatccataatatatctttttcttatatctttaaaatttttacaagataaaatgaaaattgaactaacttagacaaaggttattttcaaattataaaagtatatagatttcaaaatgtttattgaatacttatgcacaatggtcaaaacacttatatttttatataatacactatgatttttagcattctgagcaaatatgtgaaaccttttagatatttgcattattgttaacaaagaagttagtgaaacatgtcacatatatacagtttttttatattagcttgaatttcttaaaatcagcctttaccaggtatattagtccattctcactctgctaataaagacttacctgagactgggtaatttataaagaaaagaggtttaattgactcacagttcagcgtggcttgggaggcctcaggaaacttacatcatggtggaaggggaaacaaacacgtcgttcttcacatggcaacaggaaggagaagtgctgagcaaagaggggaaagccccttgtaataccatcagatcttatgagaactcatttgctatcatgaaaacagcagcatgagggtaaccagccccatgattcaattacttcccaccgggtccctcccacaacacatggggataataggaattacactcaagatgagatgtgggtgtggacacgccaaactatatcatttcatccctgccctctttcaagtctcatgtcctcacatttcaaaacgcaatcatgccctcccatcagtccctcaaagtcttaactcattccagcattaactacaaagtccaagtccaaagtctcatctgagacaaggcaataccctttcagctatgggcctgtaaaatcaaaagcgagttagttacttactagatacaatgagggtacaggcaatgggtaaatacatccatatcaattgggagaaattggcaaaaacagagaggccacaggccccatgccagtccaaaatccaatagggcagtcattaaaccttaaagttccaaaatgatctttgactccacgtttcacgtccaggtcatattggtgcaagaggtgggctcccacagccttgggcagctccacccctgtggctttgcagggtacagtccccctccccgctgctttcataggctggcattgagttcctgcagcctttccagatgcacggtgcaagctgtttggtggatctaccattctgggatctgaaggagggtggccctcttctcaaagcttcaataggcagtgccccagtggggactctgtgtgggggctctgaccccacatttcctttccacactgccctagcagagttcttcatgagggctccatgcctgtagcaaacttctccctggatatcccagcatttccatacatcctctgaaacctaggcagaggttccgaaacctccaatcttgtcttctgtgcatccactggcccaacaccacgtggaagctgccaaggcttggggcttgcactgtctgaagcaacagactgagctgtaccttggccccgtttagtcacagctggcattgagccagttgggactcagggcaccatgtcttgaagctgcacagagcaagggggccctggttttggttcaataaggcattttttcattttaggccttcaggcttgtgatgggagcggctgccatgaaggtctctgacatgtcctggagacattttccccattttcttggtgattcacatttggcttcttgttacttatgcaaattcctgcagtgtgcttgaatttctctccagaaaatgggtttttcttttttattgcgtcttcaggctgcaattttttaaacttttatgctctgattactcttgaatgccttgttgcttagaaatttattctgccagataccctaaatcatctctctcaggttcaaagttccacagatctctaggtcaggggcaaaaagctgccagtctccttgctgaagcatagcaagagtcacctttgctccagttcccaacaagttcctcatcttcatctgagatgaccacttcactgtccatatcactatcagcattttggtcaaagccattcaacaagtttctaggaagttccaaattttcccacatcttcctatcttctgagccctccaagtctctagaaagttccaaacttttccaagttttcttgtcttcttctgagccctccgaattgttccaacctgttcttgttacccagttccaaagtggtttccatatttttgggtatccttatagccccactcccttggtactaatttactgcatcagtttgttctcacactgctaataaagacgcaccccaaactgggtaatttataaaggaaagaggtttaattgaatcacagtcctgaggctgggaatgtctcaggaagcttacattcatggcagatggggaagcaaacacgtccttgttcacatggcagcaagaaggagaaatactgaataaagagagaaaagccccttacaaaaccatcagatctcacgaggactcactcactatcataagaacagcctgaggaaccacccccatgatttaattacctgctaccgggtttctcccttgacacgtggggattattggaactacaattcaagatgagatttgggtggggacatggccaaaccatatcaccaagatataaaattaagttgcctcactttaataacaaggttgagttacattttaaaattattattaaagtatatatgtgtgtgtgtgtgtgtgtgtgtgtatatatatatacatatatgtctttaaagttatgttaagtgttccatgtactactgtattgagcacatagaggtgctcagtaaatgtcaatgttaggtgaataaatgagcggataaaatatggaccaacttagctggtcagtgagtttatggttacttatctttgagaagcatcttttgcctttctccatattgagattgtttaattgagctgtgtaacttttgtatatgttattatatgtgtttaaattttgtatatattttgtctaccttagtagcaaattttattgagaatatttttttctcaaaatagcatccctttaaactagaaaaaaaaacagtttttatagctctcttttgaactaaatactaaagaataaattggtcaagttctttctctgatcatgaagtacctgcaaactgcttcccataaatggcagaaaaggttaagagacattaccaggatggctgccccaaattgttgctggtatcattaaaatagtcaacaaaaatgtggagcctacagccttgtaaaaataggaacatttaaatccatactttagtcatttcctctccctgatttatgttttcttggttgtttgcaggcgcagtcaacagcagtggaagagctggctcatgtgtggctcaggctgactccacaatcagagtgattatgtggaaatcaatcagaattttcttcttagaagatgtttgttctgacataatgactgacattccagctaatttttattcataggcttctccttgcacaatgatctctatttctctcaatgttattctgtgtctttcttgcttgcctgcacattctgaaaaaaaaaggaaagcaattccctacattttattttgatacttaatgttgtttgctaacatattcagaacacaatgcaactttatatattagagcacttataatatatattaggaaaacatcaattaggtaccaccagttattttagacaggtatctcttaggtaaaatgtggtgaaaatagaggggcaatgatagaattcatatgtgaaagagtcaattggccatcattatgccaaaattattttgtggttcaggggacattttaaactttaatttttaagaattaaactttaattaaatttattgtagtttaaatgcaatcacaaggaaagactctgaactggaaacaccaagccaagctctttcctagttctggtcccctataaaccctgaaagttaatgcaattattgtaatttttaaaccaccgagttctcagggtgattagttatgcagcaatagatagcctgaaaaggaccattctttctggcactgaaaattaagaagagtgattaacaacataagaatgtagtttgtgctgtctgccacagatttatgttgtagcttcagtgattgcttcaaagcacccttactaattgccagcctattgctgatacctagctaaattagcatgtgttagttttgataccactataggcatttaaaggatagctgatacattctatataaaatataattattttcctatctttagtttatcctaaagtagcagctattatattcgcttcttgattagctttatacataaccagagaaagtaaaatatcacagagtatatttgaagacataaaagtctttggacaaagctcaagtaatgaatcaggatgctattacatcctccacatgacagtaaatatattttatattcctaaattttaagcttttaacaaaagcaaattttatactggactatttcaatttctagggaaaggaaattatcatttactgtctttgaggctataatctatttagccattatttttatattgatcaatttataataaaggtaagagaaaatactaccacatatatgttgtttatataattttaactttcataattaaaatactgggtatactgcaagatgtcaatatttataatagcttatatttggaaacaattatactttatatactcctaatccattgccttgtgtgtcattgaagaaattgaagttcacaataatgactgaacaaatgctcaaagctggtctgtggcagaaccaaaaatttccatggcacctttctctttccatattggggtgatctgcctaatttgactttctgcttatatgtctagactctacccctcattccttctgctagtgtgttgttgaaccctttctattaacccactctcgatttttctgttgcacaatcaatctgtagcctgaatgttgagtcccaaatgcatgagctacctggccgagtaatctaactagattagcctgagtatatcactttaaggccaatgtaaagttatgttgtaactacctcatagttttgcagaggcaagaaatagaagttaaggaagagaagaagccaatcttgaatcagttagaatttccttggacatagaaaatctctacaagcaaaaacccatttgattgaacaagcaagcttatgcagttaaatatatcaaagatcttgtcacaaaaagtgtaaagggaaagtaaaataaggagggagcatgaagaagccagcttatattaaagattcaaagcagggatataaggaaattcaagccaaaaataaggaagaattcttataaatgccccaagaatgaattcgatgtttggtcgatattccaacagatttagtaatgctatttttaaagtcaacaggctgcccatttttgcctcacactctgactgcatgtaatctgtcaagtactctgatgagttctggagatgctaatgcaaaaaagatataaaatccttaccttgaaaatgtagttcacaatttagccatggagttatggcaagcatcttgtcttcaattttagcccctcctccatccctctcccagacacccattgtcctctttctcaccacatccacccccttttttgtcctgtctttggtgcactatttataattcttctcatgtctaccacaactattttgggtagtaagaacatcagtatggagaccccttaatcctaactaatatcaactctatctgtttggtattaattcttgtttattgaacttgaggcattgagtactacaaaaattataatacactactggtgaacattactttattaatgattaggttccacttggatgtttgtcattcgtatgtagctgttctctccttgtagcctgtaaactttctatggatgtcacaaaaagagttttaaggattttgcttaaattaaaattaatacatcaagaaaatactatgcctcaaacaaaaaataatcagttaatttagtttttagaaatcttttacaaaaaacgtgatatttaataatctttatgcaaggatttttgggatattaaaattgtcacagatttaataatacgttttattgtataaaatttttcttttctcttcaaagtgttgggagagtgaattctctaagtaaaaactgaagagtaagatgttatcattaaacatttcagaaaatgcacactatcgtagactgcgcactgtgaaaatgatcagctagtagaggttttggtgaacatatagtaacttttatcaacaagtaatgtgaatatgtgaaatctattgcttttccaaaagaaagaaacttttacacttcttggtaaagataaactttcatgtaagaaaaaataaaaacataattttagcaatccaaaccatactaaaatcataaacacttgaccacatgtttgagtaccccaaaaattgttcctgtgtggattcttcttctaggatgatcagtcctcatggccttactactctccatttctgtcccactgaggttagccaaagttcacttgccttgtcagttaagtttctaaatcagatgagttatgttttctataattgagttaaccacagttaattgcttaatagactctgtctacactaactgaaaaaaaagaattaattgcttggagaaaatgcattatatattttattcacatctacagtcatccaggccaaagtgacaaaggcactttcaacagtggccagggccaatggcgacagcggggccagtgcttagctcagccatgtgttcaatctagtactttgggatgtggatataaagaaaatgagttataaatgaacttctccttagagcttaattcattattattattattattattattatttctttacataagaaaataattttaggagtgctttggcaaaagtttaggtacaatttaagaaaatgccatttgtaaaaaaaaaaaaaagactagnntttttttttaattaagtttttacttttaatgatttagatttaggttttaaaaatgtatttcctagccaaggtctaacaccaggtatctgagatttttctaaattttctctgaaaacatgagacgcacgtacagttatttaaaatttgctgcagccatttttaatagattttttatgtttgaagagatgccaatcgcttattatagtaagctatgatagcaatgccaatgaatcctcaattccattgcttaaatataagtgaaataataaaggaaaagaccagtattgaatatattgcctcttcctgctacactctaacatattcactacaataaatggaaagttgcacatacaataaaaacttaggcaatttatttatttacttattttttatttatttttttgatatggagtctcgctctgtcgcccaggctggagtgcagtggtgcgatctcggctcactgcaagctccgcctcccgggttcacgccattctcctgcctcagcctccctagaagctgggactacaggcgcccgccaccacgcccggctaattttttgtatttctagtagagacggggtttcaccgtgttaaccaggatggtctcgatctcctgacctcctgatccacccacctcggcctcccaaagtgctgggattacaggcgtgagccactgcacccggccggtaatttatttaagtataattgataatcagggcaatatcagaaaatcttgaataatttgtactctaaaatgaatttatgcttttcagtgctggaagcattatagaggttgtttcaactatgaaatcattttgtcaaacgttctttgaagtctatgaccttaagtaaagcatttaaaacccaatggtttagaaacgtccagagaaacaagtatattggcaattgtaaataatttttgaagtatttagcaaaacagcgaagtacaataagcatcctattcacaattccaatgtaaaaagagatctggtcataggcagaattatactaagaaaaaccctatgaagaaaataaagcttgtttgttacctccaagatttcaccatctttttcccgtgtccctgcatctatgccctactgtttctgcttcctcattaatcttaaatcgacttaagtggatactggttgtttaaatatttcttatctgtatcacaagttcaacaaggaaaatatcttgataataaaaaaagccaaaggaagcttttaaaaatttacccatggattgtaattacccatgatccccatcctattcctttagaactgttagataagagttttctacacttgaaactttgagtgtttctaaaaatatttcctgctttgagcttaccaagttgatagataccgtccagacagggtgaactgaagcaagagtccctggctcgaaagtgtgcctggcatgttctaataaaacaaaaaggccgcacgggtgctcctaaaagggaataaagtcagcaagtggggagaggggcatgtatgacttcttgttgattattagaagaacattgagaaatgcaaaaccactttgtggttttgtgaatccactgctgttttcaggatacactgcgaggggtaatggcacaaaagggaaatctcctggttgatagtttggtaatctagacagaaggtggtgttggctagaatcaaggtaatagcaagtcgagttatcagaaatgtggaaattggttttatattgagaaacaagccgatggtgctgctgagaattgcacgtgtagtgagggagaacaaagggactcaagagtatatttttttaaccaaagcagctagaaagatgacattgcctttgtacccttcattctctaattgtattccccatctctgccttcattctctgattacctttcccaacaggtagctttagcttgtccacacctaactatgcttctgtctagggccttgacacttcgcgattccttccacctggaatgcagttgcccaagatatcctcatcaattatctctcatatttttcaagtttttatttgaatgtcaccttttcaatacaacttgccttgccccccatcttagattgtatccccctaaatacacttcctgtctaccttctccgattcgtttttctccatagcgcttatcccaatctaacaaacatattttacttattttatttattgcctatttccccagtaaaaaggcagctcaataacaaggatgtctgcttgttttgttcactactctctctccaaagcctggaatagtatttggcatataatagcacaataaatatgggttagatgcatgaattaatgcagggaattagccaagctatttactgtactctggtctctgagaaaatttgcaagcaggagaaagattgctctatggaaaaacgtatgaatcaaagcaaaaaactccatcatggtgtatccagatgaaagttgtttattgtaatttagtttgtgataaagtcttcatcataaggaggatgaaaacaaaagccctagtagtatcagatcctcagagaagagctaataagctgagctccttaacatgactcatgctttctctaacttgggggaatggttggccccaactctcactgagtctgcacactgaggaaaactcctcaaaatctagcagcctggaaggatgaatgcaaaagaacagtaacaccaatattccctctacccagctgacatttctctcccatccttcatttccttaccataaccctctgtgctagcccattgttcatggataatgtccaagaatgtacaatgatatacaagatcatgataattgaattccaacttctgtcatttttcttcgtgcccccccatatccagtgattctgaactgctacagttctgtaaaccaaacatcccttttccccaattttataactaaacgcttttacttttttattcttcctagaatagcctttcttatctcatatctttgtaaattttaattcatcctttaataatcatttatagcagttcttcattagtgaaattcctgatacatttcccaccctctctgaaaaattaattgctcccttattgatttcccattgattctaatagttatgaaatattttattacaattactggttcacacatctgaattctgcttggagctgtgaagaatctgaaggcaagaaacatattctactttctttgtataaaatggacttatcacataataatggctcattagggtgaatgaatgattaatattaacaaagaaaattgtcaaaattaggtaagcttcttttaaaaagttgaagttaaacattagccatatgttttctggaaaactgagcactttctgatgtgtttgaaatcacattgagaaagtcgtctcttttgctacttttgtttactggaatgaagggtaactggaaagatttcccagagaaaacaagaccacaaatgttttgaagtagggaaaaatattttaattgaaatagaggtggtacaaagacaagaaatatgacatgtgatacagtagatataagcgtatatgaaatatatgggatgaacatccatacaggtttcacaggactgaaaggtgcaactggtacagagagtctggttgttgaagtatttaaaactcacaatcaaagctctgatagtaggatgcaatgtcaatgattactaatcgagacaaatttgctcaagatcattgtataattacacccaaattccaatttgtgaatagatttactcatcgtgacctagctgataacatggaaagataaacaaggcagatacacagaacattttgcagactatggtggctgcaagaatagcttttcgcttgattcaggctttaagtgttagcctgaacactcagaacgcgatttattgttggaaagggattaacgaagacatttatttcagaggctactttgttgttgttgacatttttgttgttgttgacttttttgttgttgttcttccctctcatctgggatatttcccttgcccttctgacggcttgtcaatggggaggtgttcgttcctgctttatctattgcatatctgtctgcttaatatgaatctattacacagaataaggaaatacatttagggctgactaatgtaaaaatactctttgatgagcagtacactgcaacatagctcagagttttcaaatttattatattggctcttccaaatatgttattcatatttgctgagagttgcttttataaatttctgctttggagcatacagctcagtggaaagatatgtgtttatctgaattagctggctctaatcccaaatgaatatttgtacaaatctgtttttaacattgatattaatttattagacaattagaatatggcaaatgatgcaaagtttggaacttgtttcacatttttttaatggtttgtactcactcccctcccccatatacgagattttaaaagtctatagggatatcttagtacatatttatgcagattacttttttatttatggaaggggattgcttgatcctccaggtggttataaaactgctatttcattttgacatgatataaattggtttagagaaaacaaattattctaaagtctttagaaaccaaaatgatgctgttggagcatagtaataacgtaaataaatctagaagatggagatttttatatttctagaactagatgggtttgtcctggatcatgcctctgaatttagtctctgatttttatccaggggtgatttttgacttgtataaaaccatggaaaccaagagccatcataaagcaagaatcggtttacaatctttggaaatgtgtatttacgtagaccatgaaataaaaaatattttgttcaagaaaagttgtttttaatgctgctctgaacagcagaccaaaaataacatttttaagagcaagcaagtcgtttttgtgttttacttgcctgccttataaatatggaatgttggacccagaagaatacctgagtttaggaccatacattcttttaggtaaaattttattgaaaattaaagtatatatagaaaagtgcacaaatcagaagcctacggctcaatggatttcaagtgaatatagccatgtaactagcatgccaataaaataacacattgatagagcattacccgacccgggccttctcatgcctcatcccaaaggtaattgctattctgccttttaattattacatattagtttggcctattctcttgaacacaactcttcaatgcttgtaagttccattttagaagatcttgcaagtggaatttgccttctcccactagtcagtctttaaccaggagatatcaagatggaatcagaggaaatctaagcactttaagtggttttgccgtgacagcatcctttgtgattactgaaagaaagctggaagttgataaagtgatccatgttgaaagtacagattgtgctttgatagtggccatgttgttcctgccacaatgtttccctgcactatttttgcccaatattggatttaacagtaaaagtttaagtaatgccatattccactaacatataacaaaaaaatggaattagaaataggtagcaaattttaaagatcagagaaaaaggaattgtgacatttaagaattacatgtggttagagatctttatatatcaacatattgaaagaaattaattcagtcagttcaggcatgacgtttatttttaacaattagtattctattctctataatcatgttccacagtttaaagtgcttaatgagttcttactggaaggggactatttcgggagagtataatggcctttaatcacttcactcaagctattagcaggaaagattgtcaggaaatattgttacttttgttataaaatcaattgaactttcacttggatgaaacaagaagtttgtcaatatggtatataacctccaaggtctttctcccttttccttatgctatttccccctcgtcttcgccatgtgttattgattcatttgaataatctatgattattttccttcttaatagcctgagaagaaaaatagcttctaactaagcagctaccaagtccttaagctagatgctatgtttatattatctcaattaatcccactcagtgtagtcgatggtatgaccctgttacaattgtgcaaaatggagtttcaggaagatacacaatttgctcattatcaaactctcataacatccacagaaaataattgaaacacaaagccatatgactcttaacctctactgaaagatgcttttatatagaatctaaaatgttatgttagatataatatattggctggtgaagttttatcttttccaaaacagaacaatattttagtgttttctcagtgaaaatagtgaacactattcagattcaggtgatgatatctttgattatcctcatgagagagtcagtgtaggtagttcagtgggtctcaaagcatagtacctggacaagcagcaacagtgacatctgtgagtttgttacacacacacattcatgagccctaccttaaatctctgaatatccaagcatgcgatccaggaaattctattttaataggttctcgagatgattcttatatgcattaaggtttgggaaccactgacatatttcttaaaagcacgaattgcggaaacagactgtgtaagtttatattcatgttctgtgaaatactagctatgtgacattgaacaattaatttatctttctggatctcagtcttcttcatttatgaaacttatacaataatcatatctgcatcacgttgttttcagaattgttgaacacacatagaaaagtgtcatgctagggccaggcacggtggctcacgcctgtaattccagcactttgggaggccaaggcgggtgcatcacctgaggtcaggagctctagagcagcctggccaacacggtgaaactccatctctagtaaaaatacaaaaaattagcctggcattgtggcagcagcctgtaatcccagctactcgggaggctgaggcgggagaatcgcttgaacctaggaagcagaggttgcagtgagctgagatcgtgccactgcactccagccaggaaacaagagtgaaactccatctcaaaaaaaaaaaaaaaaaaaagaaagaaaagaaaaagaaaagtggcatgctcatagcaagtactatgttagtgatagtaaatgcatggatcttgttttcataatacaaattaattaatgatataaagcattcattaaatatctcaatatttggaaccttttcttttaataataaagtctagtaaatgttgttattgaatagaaatacacttttaaaaacgttgtgcattattttaaaaatatatgaatcagaaaaggaaaggtgatggaaaactcatacaaatatagtaaattgcactgtttttgtgaagatgattttatgcagaattcaaagtagatgcaattagtgcttcaaattagaaactgcaaatgatgaattcacaagcacatgatttaacaaacaaatcagagaagagaaaaagtttctgatgaatttgagtttctacatgtggatttcatcttgtgataagccattctcaggagaaagcatgagatgttattcgtcattccagaaagtgggagaacataaaagttgagaacagttattgcataagcaagaattatcaatgaacacaattaatttaatacatacacaggcatttgactgtatgagaaaaagcatttcatgttatttgctttgtagatacaatatcagtttcgatgagattcatgctgcacggatggttacacctgtcacctgtgggtgggtaatcttaatacctgtgatgacaagtagaccacgggggaggactcgcaaaggatttgagtgaggagccactgatgctgtgtaaatgccagagccgtgaccgtgcacttttggggggatgtgcttaaatatcttcagatttcacagaagttagggcatcaacggaaaatacttttgttttttctagctcatctgcacaagttgaacacacattgttagatagtgtgtatgtcagagcatatgtgaacaaatgaaggcgaaaagtcaatagccatacatttgtatttgtattgctctttatcaatctaaaaaggtacattaaacaataaaatgacaattcaatttttaacagcattctagactctagaaggtgttttctaatccactctcttaagccattctcacaacagtacaagggagaatttcaatgagaccaggtcacccagcaatatggtgacacagatgagacacctcctcagatttttgtttcaaaatttttgttctgcctactatgccatacatgctgtaatcatttaattagaatttatattttaataaatgaaaactaaagagtttttgcaattgtgttaacactcacgtgttaaatttgtaattatgtcggtaaataaaaagagtttaaatccacaccccattagccaggcgtggtggtgcacatctgtctgtaatcgaagttttagaaaactgaagtgggaggatcactgagcccagaagaggtggaaactgaagtgagctatgattgcatcactgcactctagcctgggagacagagcacgaccctttgtccaaaaaaagaggaaaaaaaaaaaaaagaaaacaaaaaggcgcaacacagagagaagtgatcttatccttatccttatgctagatatatattttttttctggtcagagaattacaagtctgtctaggtaggctcacatttgagaagagaaaatcctgttctattgacttagagagttaaagaccctgccataagcagagagggcacacgtgggactctgcgccaggacaggcacaactgtgggggacgcttcatagcagcttttgcagatctcctctgcacctgaagcgccgcctgtagaagctagatgaaacctcacaatgccaaagggttgctgggcttaggaagcacgggctgcatagggataactagatctttatggatcctgaagccactgccctttgtctggatatctgtctctttgtgtggccttataggctgcatttttcttgcctgtatgcctgaggtcttgatttagtcacactggcagggtacaaactggcctgactctgccagtgacttcacagtgcagttgcaatgtcatttagttaccttcccttggaggaactgctactgttgatgaagagtgctttggaccaaatattttatgggcccaaagttcatgtattaaagccctaattcctaatgtgatgatgtgaggaagtgggacctctgggaggtaaataaggtcatgagggtagagcccttatgaatgagactagtgtccatgtaagaagagatggaagatatgatctttctctccaccatttgaggacacagcaagaaggcagccttctgcaagtcaggaagagagccttcaccaagaaccctctctgtcagcactttgaactcagactccccagtctccagagttatgaaaaataaattcctgcattttaggccacccagtctaagacagagaggtaaaatatatagtgcttgggccactcgtttgttattaaattcactatgtattcagcttcacttatatccttagaaaagtttgtgaatgcagttgaatgggtggagaacggtagttgcagataatcagagaagaagagtagagacagggtgcaggggaaagtaggtcctttaaattgaaaaatgataacatgatccattcatataaatgcacttttgttcaattctgctccagctgtattatccagcttctctaaagaatggtgcctgtacaggacagggtgatctttaccctgatgaaagatggctctccaggcagatagcaggagagacattcctaattgattccaggagggaatgccaccaccatcaccactatcatttatgttgatatcaaaactgaaatgtcaatgatcatttctgttctctaacatttccaatcagataatttaaacattttactctaagagtttttcaactcaaatgttatgcttcctgttttgtgcatttgtattattaactctagtttcatgggagtcccagtttttatacatcactgtatagctttgatgttaacatgattttgagttaacataatttttgccaaagtgagtattaacctagtttgatcacacaatttggttattctttattctgatgctaagggaatccaatgatttttgttgatagtaacccatcaattctattgactgtaaagagtaatctagaagaaatttaaagaaaatttaatcagattttacgttttctgtcgctaatttggcatcttaatagctgtttattttattcgaggtgcatcctgagtcttgtaatgttcacattgcaatattaaagcataacagatgagcctaaaatgttcagtggttaatttgtacagatcaagatgttgtaattgcaataaccttaatgtggctaacccttgaataacataggtggaaactatgtggataaatccacttatctgcagatttgctgccacctcggttaccccagacacagaaaaaccaaaccctcctcttcttcccccttctcagcctactcagtatgaagacgatgaggatgaaaacctttatgatgatccacttccacttcatgaatagtaaatatattttctcttccctatggatttcttaatagcattttcttttctgcagctttattgtaagaatacagaatataaatcatacaacatacaaaatatgtgttaacttactgcttgttatctgtgaggttttcattcaacagtaggttgtcagtagtcaagcttttgaggagtctaagttacataaaaattgctgactgcgtggctggggctgggggagttggcagccataacctccacattgttcaatggtcaactgtataattttttagcggaagtgtaggaatgtttagtatgatacaaccatggagaaatattttgtataaatatgtgtaaaattaagactgtagaactaaaaataatacacttagttcattagttattaatagctaatattgatttagctctgtgataataaattgacatgcattacctcatttgtcacattgtcatgagatcaggatttttatttgtctttcatttacaaatgaggaaactaagtctaagaggagttaagtgatttacccagtattacatggcaaaaaaaaagtcagagtttaaacttaaagccgagtctttgcaattctaaagtccatgttcttagctactgcctttctgaacttattagtcaacctgaattctgaggatctcacaaaaagttacgtgctaattattttggaagcatttatattatgagtttctaaaattacaaattcttttatgtatgatagggaggtaaaatcatggcatttagaggcaaacatattctatttagttcccatttgtgctacttaacagttgtgaacctgacgagtaccatttagtaacctcaactgttaaggtgtgtaaacaagttcatttcatagaggtactggggaaagttaagcgagagaatatatgactaacaaaaaatatgattttcattttttccttgtgtgtatacttaaggggaaatttaggactgcctacttgttatcttccactgaaaacaaaacaaaacagaagattaaaaatacaaacatgttgcccttgtttattttgtctaactcaagttgttctgatatcatccatttctgtgtaaccacaagcacagttggtaaagattgagttagcaatgttccctcaattccagattgccttctctaccatctaatttctttcagtggtaccacaattcttccatgctgtaatagaaactttgaaattatattttgctatttttctcttttgcatcattattttacattttgttgtcaaatatttattttctgcagaatatcttataatcccatgcttctaatttctagtcagtgactttcttgattcttattcctctaatgtacaatccaaataacactttcttctcttctttcatttaacaagtaataatttaacgtcaacactgtgtcatatctgtggtgtcacctatcagtatgcagaacaccaagggattcccactgtagtgtgattcttcttcttgtgtattaacaccaatgctttcttggcctcttaacgcttcctccttgatatttttcagttccaggcactctgccacacactctcatggccacacacaggaccttgttaacacctggaaattctccatctttgaactatgaaagattagtatctgcaatcagtaaatggcatcatctctcatagcttttattccccaatgccttctattcagccttgaactttgttttttttctgcctgctgcttcttccctcattaagccagccacatcattcgatcccttcactcacagcattttcaagaacatcccctcttcctctttttatcttcagtcactctggtgtgaatatcttaacaattatacaatacactttcagtgttcctagactcctgttgttagagacagctgtgtaacagaatgccctggtgcagactgggggtccctggataccgagggtctccagtttcagctggcctcctcccttaggtaagagatagaaacaagaatcttagtattattctaatgttcaagtatctggtcttttctgctatagttttcccccataaatcttgatttttagccatattaagtgtttttttcctttaccagataaacaattttgtctccagactttctgccattttcactttttttacctgccaaactttttgtgtctttacgtactcaatttaaaatcctcctttatgagatttcagctttttctcttggactgagattgagaacctctctctgggctccaataatttcaaatgtctgcttaaattttgaagcataatttcattttatgagaatacatagatttcagactactaagcaatagaaatatggatacaagacatacacgggaccacttggggcatagtaagtattcaagaatactgaatacttggtggatatttggtgagtgtattaggccgttttcacaccgctataaagaacttcccgagactgcgtaatttataaagaaaagaggtttagttgactcacagttctgcatggctggggaggcctcaggaaacttagaataatggtgaaaggggaagcaggcatgtcttacatggcagcaggtgagacagagagagagagaaagaaaaaaaacagccacttataaagctatcagatctcgtgataactcactcactgtcacaagagaagcaaggtggaaaccactcccatgatccaaacacctcccactgtgccccttcaccaacaggtgaagattacaatttggattacaatttgagatgagatttgggtggggacacaaccaaaccacatcagggagtattataattggtaaagaatgactgtccctagtgcattgaaatgtaagtctcatggaactaacctatatttgtttaatgcaaatttgaattcaagatggcagactaaacatatgcattttttacttatctttccaagtctttgttaagttttaaacggattatataaaagagcaagaagacaagaattaaaaaagaagtagtaagccacatgggaagtatgcatgagagttagaagctgaggaagtgagtagtaatctaaaatctcagagaggttttgggttcataggtgtgcaaaaagagaatgagcattgggtccaaaaaacaaggcgaataatggaaggtgaatagttgaacagttgcgctgatcagtctagctttgcagctcattgtcaaagaagagatcaagttggaatttttggccaaatactatagggttgtctgtgatatttaatagtaactgagtgagcagcctgagagtcaagactgttagctatgttttgagaccccaaagtaaaccccttgcattttatcagttgacagaagagaagtgctctacatgtgccctgacttaagcttatttttcattcgtaagtgttaggtaatttttagtaatatcattagccttctatatgtagagttatgtgagaattaaaggtctctttccctgcaatctcagacagaattctactgtacatgcaaacatgtattatcaagtatggacaaaatcaattgtactgagtataatgaagtccaggttctctgccttttatgtcctctaattgtacacagcataaaatgttgactcaagccagagcacaaaatactcaaaggacagaattcagcttatcttatggtcagatatttgcactaaaataattgaatcagtgattggatacaaagacttggatgacatcacaaagtgttcaggctcttgaacttcctaggtccttataaccttcttttgaaacaatagaggccgggcatggtggctcatgcctgtaatcccagcactttgggaggccaaggcgggtggatcacgaggtctagagatagagactatcctggccaacatggtgaaatcttgtctcttctaaaaatacaaaaattagctgggcatggtggtgtgtgcctgtagtcccagctactcggaggggtgaggtaggagagtcgcttgaacctgggaggcgggggttgcagtgagtggagattgtgccactgcactccaacctggtgacagagcgagactccaaaaaaaaaaaagaaaaaaggaaaaataggagtacatatggaattctaggcatctcacaaatctttaacgttagtatttcttcaattaaaatactttttaaaaattctaaccgctagaccactagagaaaaatacttttggttttattaaatacgttatttaaccaacctctggtctcatcagagagaaaaatagatggcatgtttttacctttccttgtttcaggcttctgattagaattcctactagtcaaccatttccagggtgcacattcttaatatttctcaaaatttatattaggctgaaacctacaaaatttatttttttaagatcaaagaatgtcaaatattagcaagtcacatggtttatactgttaaagcaaactaaatatggcctgagaaagactttgtacttctgtatttgagaccttgtggatgaaccgcaacctaaattaataggcagagaaaattttaaacttaacttaggagttagcacttataacaatagctgggtcttggtaaatcccagcagccatacttcagccactcatacaccgctgagtattcaaactgtgttcaaataaggcaaatgccaatctgtaaccagtccagctgtttctgtacctcacttctgattcctgtatgtcacgtcactttatttgtctataaatttgttctgaccacaaggcatccctggagtctctctgaatctgctgtgattctgggggctgcccaattcatgaatcgttcattgctccattaaactcctttaaattagtttggctgaaattttccttttaacaataccatctctcctgggagagtcaaactcatatggcaggtgaggattcagagagattgttttccaaaagatagaaagtaaagttgccattttcttaaggtctaggcagagaaactggtatagctgtacttctaccatattctatcagttacacactgtcatggagcaggctcttatgcaatggaagaggacaaaggtggcctcatcttccctccatgctctgttacaaatatcaatctgtctccctttgcatgccctgtctttccttggattttaggctatttcatttccttgcaatatcagctctctgttggattcaagaatagagatgattttgtagtatgttccactatttttcccccaaattattaaggtattagtaatgctctttcatgttccatatcttaagtggaagtggaactttcttgctataacttttgaattagcaattctagactctagactccaaaggagtctgtatctgcaaaagttctgagggaaaataattgtgaagttaaaattctaaaaaagaaaaaatccttgtttaactaaattatcattctaaaataacaaaaaatgatattttataattataagaactaaggaaattgtctttatataaatgtctggagaaatagatttctgagaatatatttcagcaaaacaaggaaaaaataacacggggatatactgggactgaagtaacagtgcctcttaccccagagataagtgacatgaggtcccagaatcattttaagcaggcttagaagccgaatgtataaaatatatcatgtaaaatataacgtgacacagagggcacttagggtcattctgattcttgaccttgatctgagtttcaatgacgaaaatagattggccaaagaatgacatactagccacgcctttattttcattacatacactttttactccatactgcacagatatatacaattattttatcttcctaaccaggcaataagttacttgcccatcttcttattaacaataatgtagataaagtatcttatgaaagtagagaaatgtagtcagttatttgataagtgtgtgagtttgttcatatggtcttataggaaataacaaacataatttaaattggtacaggttgtacacagaacatttaaaaaagttctacctaatcttaaaaccatggatttttacttaatgtttctgcattttataatcattaaaaacaatggaaattttgttgagcttaatatgaattaaaatttttatattaggatatcgtaggttttgccaatagaattctaaaacttaaatatatctaatttgattactatgtaggttatgcactgtgactcattagaatatatgatgtgttgtttaaagtcataatgatcatcagatgaaatatggccatctttaaagttatctcatagatctaagtagtgaataaacgagacaagagtaatgtaaaaatggttgacattatcaatgaagggtcaatggataactgcgtggctccggttctgatactcagaaggaaaccacatcacttaagtagtaatatgaggaaaatgaaccacatttttaggaaacatcacacaaactgtaaaccaagaacactttactattaaactttttttcaaatatgccaatgccatgaaaaaaaacaaagagctgaggacccattccagtttaaaggagactcaagagacattacgaccgaatcctctatgtgatgtaacataagctatcaaagacattaacttggtcaattcataaaactgaaatctggaaggtagatcaaataaaggttttctatcaacattctgtttcctgaaacggtagcttgtggttaacaaagaggatgcccttgtagttagtactaagggttgtagggtccgtgtgtcagtgacttgcacttggcagtgagtgcgtgggcgtacgagcatgcacaccacacagtgcacacaggggtgatgcaacagtcagtacatccaggaaaaggatttatggcagctccgagtgagtgcgtgggtgtacaagcatgcacaccacacagtgcacacgagggtgacgtaacagtcagtacacccaggaaaaggatttaggggagctctgagtgtgtggatgtacaggcttgcacacacacagcacacacggagatgatgcaacagtcagtacatccgggaaaagcacttatgggagctctgtgtactattgttgcaatttttctgtaagcttgaaattgtcctcaaataaaagtgaaaaaatgttaccccaggaaggattggcacaacattattttagatgaatacttcgaaaacttcctttattttttgaaagttactggaacacgctgattacacatttgggatttaacccctctgccttaagtataaacttagacgtaagtgtaagaacccagtttaagttatcttgagaagcacaaaatttgagttactacacagtttccttttaaatggaaatgaaatacatttcaagtcatactaatatatgttggttttgaactacttgtagcccttccttagaaaactaaaacaaaaactctcttttaatttcatgactccttcaaatacggaaactatgaagatttatgtcttatgaagtttattttacacataagttattagattcttttaaaattattattattattatttatttttagagacaaagtctcactctgtaaccaagactggagtgctgtggcaaaatcatatctcactgcagcttcaaattcctgggctcaagccaccttcttgcctcagcctcctgagttgctgggattacaggcatgagctaccatgctgagcatacaaattatttggtctgatgaaataattattgataaaatcaacagaagtgatcattataagttaaatatttacagtgtgatttagagaacatacctgtagaaaggattgaaacaataaaatattattggcttggaatttgtatagaattttgcccttcaatatagactgtcatctaaacactcaaatagaagacattcaaatttacaaaatggtgctttattggccagcctagataatttttcttgcttcctcagccccctttttacttactcctgagggcttaatatcacagacaactgaaattcatctgcactctacttactatgtgtaaccagctgtgattttattttctgatgctaccacatgaaaaaaaawtttttttcctgagctatagatgttaattggtgtctttgtatcttgctaattaagttctagcaacaccttctccctcttcctcgtttgcacttaatgagctcacttgttgtattaatttataagataattagataaaacaaaaaaagttgaatttcttcaggagtggctttggaaagtgccccttaaatattcaaacatggataaaaatgtgtacattacaagacaaaaaaatcactttaagaagaaatatacttaatgttagcctgtagactcatactgacattttaaataatgtgatgatcagggcttatacaaaaaggaagagattgattcaaaagctcaggcaatcacaattattttggtgtaagcaaaacaggatcacatatggtacaacatgatgctcataccagaaacctttgcaatatttaagcacaacaaacaaattagttaagcaatgtgccccttggactctaattaccatttttatttgcatgttcatttttttctaaaatttttttaagccagtggccaggcagtattaaattctttgctgtttatcatgataccagaatttatttgacaaaaagtggaaaaatcattgacgtacagtgaaactgatcattgtttaatagtagaattctgtcgttcatcagcagttagggaattgtggaaattgttttgagtgagaacatccagatgttattgattccaattttctggtccaactcaaactcatttgggccattagctttccaacttgtccaatatcatcagaaaaggcaatggcatctcttactgctctatttttgtctttggttgagtaatggattccacttgactggcatatatattctggctgccctttaggaaatctaagcatttgatgtcaaaaatacacatcttttaaaatacttcttaatattgaggtaaagcaaacattcaaaattcaaaatatcaagctgtaaatgttaatactaaacaggaacatatccaatcgacattgaaattgtatataatgaacaagaaacaataaattaaagtggaaagtcataataatatgcaatatttcaggtattctttgatagatgtaatgacagaagctactaccttgcctgccccagtgttagtaacattgagctttccagctaggattagagcatttttatatgaatccttaaaaaatgcaataactactcctccaggagaggatgctgtccctgcttcctgagggatagcactaatatttccaggttgtctgctttacatcaagactttgctttaggatggaaacaggattgtagggagactgtgagctcaacagtaagattagtttgtctccatttgatcttttgatgaaatgcattggggtaaaacctcttcccagtgtcattagtagctcatgaattagaaaagataatttttctcctacatattcaagaagaatcagaaccaggtaattgacatagccaactaaacctctatagttattggttttgttctgactcaaatgctaacttgaatcccttatgactgttaagagcataaaggggaagagaatgcccagggaggcaactggagagacagagacagcagagctgtgagaagactgtttgcagaaaatattcttcccatgtgtggacttggcctttgaagcagagaattacaacaggaaattaggaataggctggtgtagcctcataaacaagtacaaaattgtgtcagcacaccaaaatatttcactagactgcccttcccctaggaggttcacaggtggtataataaatgaaatcagcaatccttctacatgtctcgcttatatggttattttggctcagccgaccattagttatttgtaagctggggcataaatacagacactagttgaatatttatgtacagctccagaatccaccttcactaatttgtctacttatggggaatatagctgtggggggcatggaaaatatttactctgggagcccttaaatgtaatgcatgaatatgaatgtgctcttggcacgggaggtcctggaactcttggtaggtgttgggtccctactgacgctttatcattttcttttttccttcaactgaatataaaactgaaaagccgcttttaacagttagtaagtggtgatactgccagactcatcctataagaagttagctaaattttatccagacataatattttttattagcttacttgtagagtccctcctcagagcccaactaaacgtggtgctaaacattcttttgcctttgtagaggaataacattctgagactcctttgttttttcaccaaacagtaaaattaaccaggtattgaattcatactctcattaaagtcattgttaccattcttttacaaaaaaaaatactcaaggagtaaagaaacataaaaattgacactaaaacaatatcacctacgttcrtctttctctggatgttagatttggaatgtatgcatagaaaatggtcttagtgtcaaagatttaatgctgcaagagaaatcatctccaaaagaatatctcctttaattctgtcttcttatttatcaaataatatctagcgaccgcacttttcttttgttccttttgtataagaaggaattatagcggtttgccacattagagtactttaaaagtgcttcctaaaatttggtagagaatcttcttaaaattttactccaccctgcatctttctggatatctatcactcctgagatggtttttccaggcttagattagttttctaaatctctcagctttcttttatctcaagtgacacagcagttaaattacatcatgagtttagcctggactctcttgagtcccccaagaaggaaaactgaaattctgcaaaatgacctatatttaagggtgaaggaattaagagacatctcaagccgtccccttattagaaggtaaactaggaatcataaaataatatatttgaccgagtgctcagaaatgattaaatccaacaggcttgccaacagagttgtaccgtagaattgccaagggagttatcataaagcacagatactgggctctgcctttgaccttctgggtagataaatgccagtgattttgaaagtaattccctgtgattctactgaatctccacaaatcttgtgtaacctctcaattttaaaaagaagttttttttttttttcagtttaagccatttattcaaagtcaaacatgctttagtgatggagaagaatctgcttttaaatgtattaaaacaaattgataggaatcatgtttcttattgttttcctgtataaagttagacaaataggatatttttgaagttataaatcatttaaatacccttaaactgtttacaatatcgtttgttatatttttatcttctggggtaatgttatttaaattaaacgaggtactgagtgcttgctgaaactaactagaaatcttaggccttaaaaatagctatctcatatttttaaaagaaacatcaataatttttatatatttttaaatttatgagatggaaagttagcttttactaatcttatcaggctaaactgagtaataatgaagaaaatgaagagtttagaaatattttttggaatatcagtgaaatctctaaaaagaaaaaaaaaaccctcatctatatgtgtgagcgacataaagtcacactttgttgaaatgcaaaatggccttggaaaatttcatggaatgaaactaaatggcagcacatcacttttccagatggggtcttgtggttgtggctcagatcatgggggtgatggcaaactcttccaaaggaaaaatagtagcaatccagtcacaagatagtaccaaacatagactcacagatgagtaatatgtcagtttcttaaaagaaagagttgttaggaatgagagtaaggatgtgcctcgattacaataccccagatacgatactattctgaaaatggtgtgggggttttgtgagggatgccaaccacacattgtgctagaaatctgcatcgggaagaaatattttttgctacatgttacaaatatgcctatagactgtgattcaaataaataatgtgtttaggccaggcgtggtggctcacgcctgtaatcccaacattttgggaggctaagccaggtggataacctgaggtcaggagttcgagaccagcttggccaacatgatgaaatgccatctctactaaaaatacaaaattagctgggtgtggcgacgggcacctgcaatctcagatactggggaagcttgaagcaggagaatcgctggaacctggcaagtggagattgcagtgatctgagatagcaccactacactccagcctgggtgacaggatgagactccatctcaaaaataaataaataaataaaaataatgtttttataattttttcatagaaaaataaacctgaagttaggcagtgcagacttgaatttctcattctcaattcccattcattttcctgtgtttttgagggtttctcctggaaagtaaaacaattcaatgctttatcttctgcccttcagaagtcgggacatcatcacatcattttacctttaagatattggactggattcatagaggaatgagccatatacaacatacataggagtatgaagaaagggagacagccttcaaagctaatttagtaactaatattgtagtttaatgtaatgagaaataaaactagaagatgattgatagaatgcagagggcactttaaatcagagagacgatttgaaagaaagaaatatttttatataccttgatttattagagatagattaaaaagttcgtttaaaaaacgtgatcaagaacttgcagtgataagttattctttttcaaatatcatgacgataatgctgcataatcacccattcaaaaatttcayggcttmgaacaacaaatattactctggagctctctgttctgtggttggctgagttttggctactcttgacttggctgagctgggaggatggatctgcttcaggctgcaagctggctgagcttggctcatcacgtttcattacgaggcacagactgaagtgtttggagaagcccaggcagtggcatgttctttaaaggcactgagaggagcttatgaatgaatgaagcttaactacataagcwcacttgatgaagtcaaaatgcaaggactgggaagtacatgccaccaaccatcaagccatggtaaagctgtcgatgtactacgggggagtggagtgctggtacgaatcattcagtctttcacaaaacactggcaaaatgcaggttattcagacagaatcgttaaatacaaaaacctacttaaaacttaagggtgtattagctatctgtctccaaatgtactttttgaatttaagttataaggactttcactgcagaaagtatgcaataatgaagaagataattgctttggtcattgggaaagtgtttttcaggtagaagtgaatgcagaaacaaccattccaagcaaaaccaatgacttccagggtaggctggaaagagaattctcttaatagaaaagaaagagcacttggaattgagatagagacgctaaactgagctactcctgttggggctttgctgatccttcatggaatacactcattaattatcacagaagccacctatgtactctgcattcattgggatttgatgtataattggttcttaacttctctatgtttagcattttgcttagaagttagcacttatcttcaggtattataaggcttttaaaatgacattttcccctctagaggaagtatgcctttgtttgtttatttgtttgttttgtcttgtttcttagagacagggtcttgctctgttgcccaggctggagtgaagtggcttcatcatagctcactgtagccttgaactcctggactcaagccatccttctgcctcagtctcccaagtagctggggctacatgcttggctaattttttattttattttatttttttagacatggggtctggctatgttgccaaggctgatctcaaactcctggcttcaaactcctggactcaagtaatcctcccacctgaaggtgggaggccagcaccttgacctttcaaagtgctgagattacaagcatgagccgctggttacaagacatggccagaagtatggggttttctatgctttcacatataatacatacttaggttttctcgatgatgaaattatgtttgggttacttttagtaaaccgtatgtgctttgaattaataaaaaagttgtgattcatttattttcaactgctacttcccttctcttttggaggtgctccgttaaaagattccctttatgttgtgtcacagagtctgaattgacacaaaagcatttccaggcattattcttgttcccggttggctgacatagagccccactcactgatggcactggggaaggacagagcctgttggacaaaccaaccctaggcattagtatcaaatggacaaaaggatcctaagacgtttagacaactgttgacttttatgaaactgagacaaaaatggtaagaaatttagataaatatttccttttgtaaaaatgacatgaattgtaagtttcctacactgtaaattagaaaatttaaattatataaaactatataaaattataatttttttcttaatattggcatttttatgtgtactaaggtatttacctcacttttagaatctcgaattctattgggagtgtattattttcaactcataaatcaccttttaaacatttgattcttataacttttccttctcaggaaaactgaacctatatttatagaatatggatgctccagcagctggttcaaaaaatgattccgtagtaataatcacatcaattatatggttaaaatgtgaagcctgagtcaccgaaaagttaggtcatttaatttgttcaatgcagtttctaaagttttcaagaagtgtattagatttaaaagagacttgaaagggaatctgatacaatgtcattacaactgagaattttctcaccagaattcttgaaagtactgaaggatgcaaccctagtgacattctcattacacatgtagatcagaaaccaagaagtctatgagtaacgtttggaaagaacaatgtttaaatatgaaaaatgatgtgactcatgattgaaaaagaaagtcatgtaaattggaagtgcaaaaactttacaggagaaatctatgagaccaaaaataggtagtaaaataaaaatgaaagtaaatatggttgcctaaaacacattaacaaatgaaacaaatagataaaaccaatgagaatgggcagcactaagagtaacagagaagtttgacccaggcaattttgatgaattacttgggaaatctggtaataatcaggtaatatgggagcagcatgattagttaataattccactttaaaaaattcacacagaaaaggacagagtatatatggaagacatgcacagcttctatattaatgtgacactgctctgagtaattaaacaccgtttccaggaaagatttgttcagttgttcctagagggtgtggatacatccaggacattcagcttcatgacttctcatttgttttagtttttatcttttaaattgggggaaaatgatgtgttattcactgatcttttcttctgagatgccaatctaaatctgttatcttattaaacaataagcagattttgttctgatttaggcaattaccatggttagtaaacaagaaaattaccctaacaatggaattaggttttgtggacatgatcaggtcatctttttgaggtatctgccttttcctgcattcataataaccactattactctgattacttttatactgtccccataagtagtggagttctcacttacgcaatgaaaaccagaattcagaggaaatgtaaccttctgaattcttattgtgcaaatttcctcttcattcagtgccatgctcacctggaagaaataatttgtcaaatattcttgccaaccaaacagcagtcatattccttcagagaattttcacactaaaaacaactattagttttacgctgacagcacaagtcaatcctaatgtctttggatcatgaatttatctacagatttcagaagaaacaagacaaacatttttgccaatgtcatccatcaatcaagtggcaaagcagatgtgtggatttcaatgcagatagtttctgtccagctgtctgctctccatcttggatgttggttttgttgtagggctggctctcctcataaacttgagatggtcgctagcaccttgtaagggtatgcagttcttccttggcatccactgaaaaaagagtggatatctttttcttaggaaattcatagttgggtattcagtcgcatgtgcattcttaaacaatcactgttgccaatagaaaacaatatattaactggctcacctaggatcctatacttgtagacagtttcagccaaatacaaagatcttaagaaagggaggattggttcctctacctcaagaaaaattaaatcaatgttgatgcaagagtgggaatgcatgttgagaggcaaacagtaaacacaacaaaatgataaatcagatctgctggccctcaatattttcttttctttgccatatcagaaaatcttctatgattcagagctcactcattaaatgcattgcccttggataaaagccattggtaaaataaccaacaagtcatcctcctttgaacctttagccatattcatgtctacctacattatgtatatttctttgcttcccacattccatcagagtaaaatacttcgcaagagccagccatgttctaggacatatggacatgaacagatttataggatgtggttttctcatcccaactcttgaaggatgaatggggatcatccatgcagatgatggagaaagtcttcaaagagaagtgaagatcaattctaacaagacgataactaaaacagcatagatgttcagagaactgcaagaagcctcattgcttaacccaaaagnatgagagagaagaggcaatgattggtagaaattagatcttcaaggatcttgtattagcacagaaaaagctgaagatgtattttatcacgaatagagtaccaacaaaataattttcatagatgagcagcatttttaccttatttatatgagaattccttctggccagagtgtggcatatcacttgggaacaggaagaatatattattgcctttagtgaggcaatgctgaggctattatattattgcctttagtgaggcaatgctgaggctattaccaaagtccaggctagaaatgaaacccaaatgaagaaggcagaagtaggtttcttgaggtgaaaacagagtcaggtcctccttaatacataggctcttacgactgggagataattaaatttagtggatggggaaatgagaagtgggggagcatgacctggttttctgacttagtgtcatagtgtgtggaaatgcattaagagaaacagaaatcgtacctgaaggaaaatgcttgtagaggaaaagagtcattttaaatatgataaatttgatgtgtacgagacatttcggtgggcaggtctaacaggtaacttacaatacatgtgtgcagagccctgtagaagaatctaggcattcagtgtctgctccagggtcatcagtatgcacgtggcagtcaaaacaataagagtggctgagatcatccagggagagtgttttgaatgagaagtaagcaaatagaagacatttggatgctgcccaatatttaatgaatgaattaaagatacagagcctgtcaaggagctgaagaatgaaaggtcagagaaataggagcatatttgaggagaagagagtgatcagcggtaaaattgaatgaacagacaccaagaaagccaaagccagccatgtagaagagcttcaaattagaaattttttaagaggcattcttaaatgaagactgtcctttattttgttttgaaagatgatttattgattctttaatcactcaatattgcaactgggatttcttcagaggtctccaagtctcctctattttcacagatcaaaattctcaggtgcagagtatgtcaggacctattcaaggttacacatttggctgacaactgtgtcaagactaaaatttcatgatcgttatttcagttcatctgaaataaatatcctccaaacataaaccataaactttatgttttaagagcacatacacctctttacatgaagtcctccagctttgtaactcctccattcttatcaggtatcacttcttcagacatccctctcttcagtcattcctctcttttcttctcagcctgtatatcataaatacctatcatttctctcttgttgtataattgactccatcatcttttgttcttcatttctacctggccctaaaacctacacatcagatcaatcctatgttctctctttttaggctccatccttgtattgaacacaatgctgtaattatgtgaattggtctaatttgaattcttgccatctaaatccttcctgagcccacagtgctgtagagaaaatatgtttctattctgggtcagcatttgacgtgctttttctgtagggttatacattccctgattattaaaagtttatttccaagctctcctttcctgtgtattcagaatatacctcacatgctgcttcacagagacagtcaatactatcagctagtagggcatacaactgtggccctgtcatgcctaaatcatatcaatttacatcctcccttctccttccactttattccccttttctttgtacaatgtcaatctgtttcaaccttggctactgcttcagacatcttgcattgtcagtcattatccttctcttgtggatctccaacatcttacctctgccaaatcttttcccttcatcagtaaccataatcagactgtatttttagatgatgtaaatttctataattttatgttagctctggcttatccctctttcttcctactcctcctcttatagtcgtgtatttaggtcacaagtacactcttaaacaataactgttgccagcagaaaacaatatattaacaggcaattatcaagtatgaactccgaatttccaacagaatatccttgatactctgtgtatgtgtgcttgtgtgtgcgtgcgtctctctctgtgtgtgtgtgtgtgtgtgtgtgtgtgtgaagacaagtttatgacaagaaggagagactcacagaaggtcatcaaaagttagaaatttaaatgagaatacgcgtgaaagtaattttctagcctgcacctgccaaagtgttttctcatagttcatgtgaagaaataccaataggttgttgtcgttagtccactacacagtgttcacctttaatgtaggtggcatgggcctaaacaaggatggaaactgatattaacagagtgttatacagcaggtgctgtactaagggctttatgaggaagggttaagttagtcatataataatatacttaaagctttaatttcatggtgggatagttcactctcatgccatcataattgttgtacaatcctgaattaaagaacttttcaagatgttattaatgaaaaatctttactgagtgaattctatctgaccctcccagtcaaaaggcttctactcaaatttggctaaaccctattagtgatgtgggtttctgactgctgccgtaacatttatttggagataagatgtgctatatattacagatggactttgggaagtgactgagggtgacagaaattaattaaccacaagcctccaaatgaaatttttatgctggtgagtaagaaatacaaatttctgaaacacagcggtatgaaataatgcagtatcaatggttaaggaagcttcctaggttttgaagttctatattaaaagatagatatgtaacaaacctgcacgttgtgcacatgtaccctaaaacttaaagtataacaataataaaactaaaaaaaaaaacaaaaaaactttgataagagagtacatcttattaatgatttcacaatgatgcctaatataatttagtgtcttggtaatttaggtaatgaataaatatgggatttcttttcaaaaaatataagtaatttttaatgaaaataatatgcagaaataaatacggggtaaagtttaataattaacaaatattccagaaggccagtagtctgcgttggtcagaatgaaactttcacagaggggagagtaaaagtgaagcagataaagtaatgaaataattgatatcagtgtctctaaagtaagaccgaggaatttgaattttgtaggcagtgaggagcctctgaaatcctgagaatggattcaacataagcaaaatcgtattttggaagcagccagctggcatgcatgggtggttggcgagaagtctccagtgagcaggtcattgcaggtgtttgtctcatgtactagtttaatgtgccggcaggggggttgctgtgagggaatttaagaagcctgaatcagcagttcttagcaactacatgaggggattaagacatgtaaaagaaagtcaactgtgactccaagatttccctgaataagttatatcttattccaacgctattttgaatatttccagggtgtatattctgaatatattcttgatatattcaagattcaacctgagtaagttacatagacctgatgacattcagtattcgaggtcagataacaatgtaactgaattctcctgtaaagagcaaaaatatgttttaattattttacaagtactcaacatattaaggaacttatctagagtttcctggaaactcaagtcacggctgttgttgattttattaattaggaagtttacatgaaccaatatagaactacactgctttatatgtataataggtcctatttttgaaatggctgatacagctttttaagtggtttttaaattgagacaacttgacatctagcttttaatatttaaaggaatgaactaggatagctattcaggtcatttgaatattttgtgcaaattctcacactcattatgtcatgtctacattcttgctgtttcatataactcaaccctccttttgaatatcatgatttaagcactcataaaatattactaaagaagccttgaggctctaagtaacgcaataattagccctcctctaatagcccaatagaatacataaataattttctcccactatttcctccccagatattgaracctcaatccgagttttaaaaactgacctatactaggtactagagatctctattggagatgctaatagattgtaaactgcatctagaaaacattaaaccagtattctaaatggtttgagagtcttacttttattctgggtcagccaactttagattcttttgtgaatgcatctttcgtctgcacttctgctctccaaataatcccctgtaacagttattttttttaatctttcacacttttattctacatctaaaaccttgacaggatttgttaatttatcttaaaaattctcatttgtaatatttatcaaaataaattagtttcragtaactatatcttgatgttttttaatacaggtttctaacatgagactgaaatctaaaatattatcatcatccaaaataatctgaaaaactgaaatacaatatatacgcacatataatatagttacagtgaataaaatctagtatttgattgcgtaacaggtgacaacagtcgacagtaatatattgtacattttaatagaactgaaagagtataattggattgtttgtaatacaaagcaaaaataaatgtttgtgatgtttgtgatgatggatatatgcccccatacaaagtgctgtgcctcatgcgtgttatcccagcattttcacaggcagaggacggtggatcacttgaggtcaggagctcgagaccagtttggccaacatggtgaaacccgtctgtactaaaaatacaaaaattagcagggcatggtggcaggcacctgtaatcccagctgttcgggaggctgaggcaggagaatcacttgaacccaggaggtggagattgcagtaggtggatattgagccactgcactccagcctgggcgacagagcgggactccaccttaaaaatatatgtatacaaatatatatacatatatattatacacacatataaatgtatgtatgtatttatacatataaatacatatatttacacacacagagggtcattatgtaacaacatgtcttcaaactgaataattttagccatcttgtcatataaagcctctaacaccacagatttaaaatttcttcctgggaagtaaatattaattaaggaaatcccaacttcttttacaaatcaaaacccatgttctccataaattaacatcataaaacattttttgttcatgtcaagcggtcaggtgtctttggggagtttagaattacctgatacctctgttcttttatatcaactccataaggaaatcccactgcattacttggtatgtgtttctgtaggcctctttagtgtaaaatttaaaagaagggggaagtttaagtaatatcaggattaatgaaataattttcaagtaaaatatatttccatgggtttacacaaagtatcttcatctgtcagtgactcttaacagcagatgcgtatttctcactcccatgaaaagttctccactggtccactgactgtgatctttgtgtcttttacccttttggatccaggtggaaggagtcccctctttgtgacactgaagtttccctagaaaaaagtaggagtcatatgatggttcttaaagtaatagacatcctttctgctcacatttccttggccaatgcaggtcacatggtcaagcctgatgtcatcagggtgggaggtgtgatcttcctataggacaggggagcaaatactttcaatctgtcataaaacctgaatgaaatagtaagatatctgttaaatctatgtttcttaaacacacatgactgtctayacagggttcctttgtgcattatttgtaatgttaatacataaaacatgaaggagagtgtgtctcrttctcatgatcaaattttacctgttatcttttctctattatcaaaatkcyggtagtcttctaatgatctttatttgtttatttattttttagttaytgaataatgataatggtgtctatttcagatctacaactttctgagttttaaagtcatggaggaaaaactataatgaaataaaatataattttatctaaaaataaataaatttggtgttaaatccaagcatattgttmttaacaggtaatacttttattgatttgggtgttttaggagttttaggagcatagaaatatatcatacctgtgtttactttattaaagaatcttttgttagaacttcccagacagcatttttggagatggtaacctgagatcatggtgtcatggtgtccttactaatcacttttaataggatatttaaaccccctttccagaaagaaaacaaggagcttccaacttcccatgtaccccatcacaaatcatccttcctctggactgtagtaacacatctaccccgtccaacacatctaccccatcctctgaggtcattgtgttaataatgtaaccacttctctcatttttctgcagtttttctccattcctgtaagtgtggtgtattagtcctttctcatactgttataaattaatacctgaaactgggtaattcataaagaaaggaagtttaattggcttacgtttctgcaggctgtacaggaagcatggttggggcggcctcaggaaacttatgatcatggcagaaggtgaagggaaagcagacatgtcttacatagtgggagcacgaagggtgcgtgaggtgccacacacatttaaacaaccaggtctcctgagaactctatcacaagacaacactaaggagatggtgctaaccattagaaaccacccccatgatccaatcacttcccaccaggcctcatctccaacactggggattacaattcaacgtgagatctgtccctacacacagccaaaccatatcatatgtcaatgttgttctctccctgaaaacaagaacaaggctgggcatggtggctcacgcctgtaatcccagcactttgggaggccaaggcaggtggatcaggaggtcaggagttcaagatcagcctgatcaacatggtgaaaccccgtctctactaaaaatacaaaattagccaggcatggtggcacgtacctgtaatcccagctactcaggaggctgagggaagagaatcacttgaacctgggaggcggagattgcagtgagctgagatcacactactgcattccagcctaggtggcagagtgagactctgtctttaaaaaaaaaaaaaaaaaaaaaaannngagcaaaaccttcccctgatgctctatatccatacatgtttttggctctgtggaccatatggactctatcacaattactcaactatgtgattgcaatgaaaacagctatgacaatataaaaatgagtgggcataacttttttcaataaaactttattcacagaaacaggtggcccaatggtggccggtagattgctgactcctctgctatagtctttctgttaacctaccccttactgtttcttcaaacaatctgcttaaaaaaagtttctatttctcatggtttccagattcttacctctgtttcatgcttgaaaactctgcaatttgacctttatacccaaagttttctgacagcttggggcaagagtggctttctgactgagtctgaagcattatctgtgaattatcttgggagtacatttccgtttggctctcctcactttagacttcttaccccatggatactctcctctgttcggtgaaactatccacccttggttctcttccagtatgtgaggtttcttctcagcatcttcatcgttaagaatgcatttaactgtaggagattcaaaaacgcaacaataaccaaaataaacaagaatttttttcagatttcaaacctaacatctggagttaaggagttcaaggttggtgcagccctttggcaatgtggccagaggtctaagcattttcctatttctgctccgtcttccatatcattttggcttttgttctcatgtttgttgccttatgggaacctcaggtttgaaatgccatggacaatgcttgtgtgtctaagacaaaaaaaaaaggacaaaattagtttgttttttaaattctttattcaatgaatcagaaaggaaaagtgtccctaagaccctggcagccatgtctccttaggtatccttggcctgaattatgccagacctgaactttgtcagttcagtgcatgagagaagctgggaaggttcatatttctagccaggggcactgcctgcttctccaaattcggttttcattaggaagaaagatgagttaaatggatattggctaaacaattgacatgtctcccagagtgacctgtgcaggatatttctcctcccataactcggtgttagtgttctaggaatttatctttcgacttctttttctgttaaactgcatgcaattcctgtgcagtctcattcactatcttagcatgacacrtaaggtgctgatgctcaaatttttctaactcagattttagtatcctatatccatctcctaaggggtttcaccttctggtttccccacgtgtatttcaaataaaagatagtctgaaagtaatgctgtttctttaaccggctatttctcatacatctctaccttgattgtaactataaaaatgataatcaagaaactgaaactcaacttctcctctcactccttcaactgctatactcaatcaactgccaagtgccatttacaaagtttcttaacatctcttgaggctattaacgtattttcatacccactgtcattctcatgactagtttcttggttaaaacctgtattatttctcactctgtctattgaagattacattctcacctggttattctgcttcccattaatactgctatcagaacactctctctgaaatagaaaccatttttctaggttaaagcccttcaacggcttgtcataattaacagcaggtaactcatacagtccctaaacaatcttatttatcccagggtattgctgaggacttcttaatctttcactcagttcagactcactcttacagctttatttggtttacaaaggatatttacctgatatctaccaggtatctcaagctgcaagactgaaatcattaccttcaaataacctccatatctatactttgtccttcgtgttcccttgtttagaagatgttttgtcaacaactccattcctcctagaagttttgtagtaatcatccctgattttctttctcctctgcttcatcactaaccagcctccttttttctgatcagccacaacatcctattgcttcaattctcttaatgcctctcaaatatactcactcygctctagtgtggtgattacagccttacttcaggctactgtaattacttgcctaaaatatgaccagattcttttaatcttttccatctgttcgttaaaagaatttattctagaggttttattttctacaatggagctacgattatattattcacttcttcaaataattcaatatcttaccattaccctctaaatgaagtccaaacttcttaccatagtttagaaagcttttccagagctggacacatctatcatagataatgctgcaggcaggttgtatctgtgaacctgtcatcacctccctctttgtacttaccacactgaggatgctgggcactgcatggcttcccctattaccatcatcatggtcctcactgtaactgtaattggaagattacatgtcctaatcctccaccctttcatcacatcatgggccttctgatctcaaccatgatgttcttcctatgcctggctctgtgtttggcaaatggtaagggccagtctgtgcccttccatgcatggatgactgattgggatgtcacctttgctcctatctctcatcccatcatcccccatcgctgcacttgactcactagcgttttctcttccctaaacagcagattcagtttgggtcttgaggcctttgcactttgtcttctctctgtgtgcaagcctctgcttttgttacactgcttgaaggattgtcacctttcaaaacaggagacttccgcatgtctgagaaagagctttaagggccgttgcatggtttggctgtctcccttttcccttttgcctgagaacgacgtttcaaatagaagctgctctttcaatctggtgaaacggcatgaggagaaaaaccatatttaacccagaggtgaaatgcaatgtcagtgagaaaaaagctaccgtgagccactgagatttggggactattccacagcacactccaacctagggaaatctgacaaaaacagaccatcatatttgaagatttgaattcaacttctctctggtctcttagccttctatcaatgtatgctagcagagaatgctaccttcttcccacagtaagaaaagaagaagaaatatcctaccttctcctcagatgtaaattatgagcttggatttccttcctgtataagttctatcagcttcaatgcatgcataggtctcttcaaaaaataaaataaataaaatagctaaagatccttcctaaatgctacttatcactccatttaccatgtccctagtgctaaacaactgtttataatcagtttaaaaaaatagttttgttctctccattcccattttgtgagctccctccagcttctcaacctttttcattttgtatttcatcctggcaatgcatgtaaacaccctttaatgttattagtcgtatgtgtgtccctaaaggcaacagataccctttccgttcccaatttatcagaagactcatggatattcaactttctggaccattccagattttataaaatgtgaccatcatttgacttcagtaactacaattgcatcattttgctcttgttgctttgcctctgcttcagattgatctcyaccctaaaatgttgctccttcacaaattaacatataactgaatatgcaacattttcacttggtgatctcaagatacatctcaaacttaacatccccaaaacaaaatatcataatttttgcctttacaaataaaaatctgtcactacaagttacgtttcagttttagaaaatcataagaaattgaattttagaatatgcattctcttgtgtcgggctttgaaagacacaatgttttgtgttttagtgtaatatttttaagatttgtccacattgcatcagatttgcccttttttattgctgagtcataatttgtatacagatataccaactgaatccagttatataaaattcatctacaattattttgtggacttatgtatttatttttcttagggaaatgtttaacagtggggttttctggtcatgtggtatgcataaattgaaatacgaaatgcagaactttctctaagcgactattgttagggtctgagattttaacctacttataagctaacatgttagtttattaatgccttatggatgcaagcagaagacacaaaacttctgggtcagagaaacaggactttattatccacagtagagcaatcagcatgagcatcatgtttgacttggctttttgtatcgtccacgtcccacagggatgacacagagggcccagatgggtggctgaagattacaggagaggaagagtgatcttggggaactcttcattttaagataactggtgagcaaacctaaactttgtcttggataaaaacatttcctcgtccctcaaagtggctcattgcaatcataaccctgagaaatggcccaggttaaaaaataataaaaagtaggagagtttgatactagatacttttctagatattttgaagtatccagaaaacgtgtggtattaggagagacccatggaggacgatttcacaacagctgagtaattttacattcccattagcaacataggaaaattatttaatttcagtaattctagtaggtgtatattaacttgaatttccttgaagaataatggtactgaacatcttttcttttcttgcttattgagcattcatatgtccttttttgcaatgtgtatgttcagaattgtttctttttaaattgggttacatcttcttatttttcagttttaagggttctttacatattattaatacactttctttgtcagatatgtgcactgcaaatatttttctctcagtctgtggcttacattttcatggtcttagagaaaccttttgaagaacaaaattttatcttggtgaaatgtaatcttttattttttagcacttagtgcttttgtattctaagaaatgtttccccaccccacaagtctgaaatttttatcttatcctttcttttacaagtttataatatgatttttgcttttttgtctatatttagttttgagttatttttgtgtatggtgtgaggtggtggtatttaccttttccaggtggaatcaacttgttctaccaacatttatttaaaagattgtcctattcctgttcttttctgattgaattatgtttgtcctttctcccactgaattctgatatttctcaaaaatcaaataataatatttgtgcatttccagttttgggctctcaataatgttctttctttatgccaatatcacactgtcttgagtgctgaatatttaaattaagtactctagccagaggtatttgatgggttccaatccattacatttattattattattataactataataataattattaatggttgtttacagaaggtaggctagtcctgtagcaaccattttgccataactaatagtgtgatattctgtttacttacaatttgatatttttcttcctttagtaaattggagattgccagaaattccttactatttctcccattgaaatagggaagcaaattcacctcaccttgaatgtgggctcattttattgacttcttgtccaacagaaggtgggacaaaaaaaaaaacattatgttattggacttccaagactaggtcatatgaatccttgaagcttctttccagctctcttggaacactttctcagtgagacccgagatgctatgtaagtctaacaaccacctcactgctgtactggggaagacacatggaggtgttctgatggacagttcctgcctagtccagaattccagatttcctgccaagatgctaagaaagtgagaatagccctcttggatcttccagaccagttcatctgccgttagtgttagtgtgaattctagaaataccatgttgaaaggaaagctccatgggtaaatacgcttctgctaataagtgggataccagaacggctgttagcagctgtcaggtggaagtggttctcgtgtcagattccagtggaagttttcagtgtctcttttccttataggcttaggatgtttctctactgctcccagcagaggtgctcagcatactccaaagaactctgactttgatatcgtgccaatcagggttcgaattcacaaatttccatttataatctgtataacattaaatcctgttccaatgtttctgtcattcagctttgtcatctctccatacagaaaaatacccacccaatgtcatcccacctctgctgcctaaacactgtattaatgttaagtggcttccccatgctatgcactgtctataaaatagggatagtatcaccttcctctggatgcattgtgaaaagtcaatgtgaccatccacgtaaaaaatttgatgttaggcacagaggatttgcttaataaatgttaggtattattcacatgaggacttgatgaaaaaaaggtaaaagcatgtatttatcacataaaagggtcaaataaatgccagtttccttcattcttttccttttagggcactttgaaaatatggaaaactagttacaacacagcctcaagaagctcatgattcactggttacttatacaagtgatcctaattatggcttgagttgtagttgttttacaaaatgtaaaaattattgagataataattagttatttacaaaacaattttgctcgtagagattttaaattctgtcattaaaaagacccacaagcctctcaattgcaaagaagttagcatcacctttttttttttaccaaattcgaaaaaagcaataatctaactacagaataaaccatgggcggtacagtacaaaaaatgttcttatgtttttaaaagttgtgcagtccattgatcaggcaggcagtggtggggagaacaaagccaaacactgaatacacgttttgctacaaagaacctagtctaatcagttccatttagaaatgcactttcatttgactatatttgcaaatcatcatttttttttctctaaaaataatatggagtgtggaaatgctttcctatgcagaaaggtttttttatttattttgctgagtttcaggaaatgaagcttagttgctaccttgcatagaaacaccaaactatagaatgcacaaatttagcacagagtctgccacgtatggcaattttgataccgctacctacaattcacatttactgcatccatccaattacacccatggtatcaatgcacagcacttagagcaggctggcagttcacaagagtgcaacggatgtcacgcagtctgcatatcagtcaatctgcttcctgatatgctttaagaaagcctgttcctcagactcacctgaaatgcaaagagagaggtggaggacgatggcccatgtttcctcttgtgtacctacactgcagttcttgttgatgaccatctaatgcaaactgtcccacaaatctttcaaagagagtaaaggtgaagccagtccctatgttaacaaacctcaaccttatttcagcagatggtaaactttgattttgtttaagaaccaaagcttcaacagcttcaggaaaacatgtgtttgtaattcatctccattttaatgccacccttgcatggacgagctacatctcctgctccaggtgaatgggttcttacgttctggacactgtgtcttcatttcagttattgatacctagagttggtgagtttcaagccaatctctaagtcaagagtttatttgggagttgggtttccttttgaaatatactccctggagcctcaggctgttgcctgttcacctgtttccttttcagaccaaatcatggaaaggaccaggttatctctgatccatttggggtgtgtaaatatcaagaaggataaggtacctttcctggacttgagaacttatagcctaataagagaagacaggaataaaaaaagaaaagttttagttgctatgagactggcatataaaagtacagggacaggacaaagaaaaaaatggaaaattatcagaaatgggtataaagatggcttcatagaggaggtaaactctgtctgagaaattagaaaatgcccagaaagacatcaaagagaaggataggctgaaaggtggaaggcataaatgctgttaaaaaaggcaaagagtcatgaaatagacaatgaatttctagaaactagaaaactggacacaatgggacagggcatggaatacaattaagtgacctctgatttaatgttcaagctagtatcaaaggagatgctgtgaattctaatcttgaaatagcacacataaaccagagctgccccaggcaaattgtgacatatggtctccctaggcataaagttaatggtatagtcagaaggttaataacgtaggaaatgaattgaaatggctgctctgacacacrctacaaagttggaacctgatgcaatgtggtaggcagaattttgttcactatgactttcacccccggtgccagctttgtgattatgttatatgcatggcagaagggacttgcagttgtaattaatgttgctattcacctgactttaacagagggaggtgatcctgggtggtccaggtgggcccagtgtaatcacacgagtctgtactagcagaagcagaaggcagacagatnagggaaagaggcaggacagagatatttgaagcctgacaaggacttgacatggtattaatagttttgaagatggcggggaacataaggaagggggtacaggtggcctctaaaagctgatgatgacctctggccaacagctgttgacctggagaagaatstgtgttaaacaagtgtggatggtgatgataataatgaagatgattttgcttatatgctgagaagacatcatgttaggagtgattacagataatgcagcaaaaaaggagcaaagtgttgaggtagaggtgagagaaggggtgagctcaagaggcaggcaggaatccttagtcaggcacagtggctatacattccttttcatttctccttggacttgcagatgcgaaacagattccttttctcagatgcccattcattaggggtggccatgtgactgaattccagccataaagatcacatgtggcattttaaggcagaagcttttcccttctcccagcagaatggaaaagctgaagcaataggaggagatgcaccatacaatcgaaggaagcagagaccctcaatatggaacaacgagaaacatccctgcagtaatagttgaacaaaaacacactcccattgtgttgtgccctttcttgacattttagactgttcattttcacagctggaccactgcaaccatcacacatgtgagaagaaggtgggtctagaaggaagaaagtgagggaagctacaaatattcatgtttgttagtggggaccatgaaggcgagatagatttcaatttcctcggccgggcatggtggctcatgcctgtaattccagcactttgggaggccaaggcgggcaaatcacctgaggtcaggagttcaagaccagcctggtctaacatggtgaaaccccatctcaactaaaaatacaaaaattagccaagtgtggtgatgggcgcctgtaaccccagctacttgggaggctgaagcaggagaatctcttgaacctgggaagcggaggttgcattgagccaagatcatgtcactacactccaggctgggtgacagagagagactccatctcaagaaaaaaaaaaaaaagatttctattttctccataaggtagtggaaatgggatctgctgacctcctgagtgtgtaggagtggaggtggagaatgggatacccaaaagcagaggagctcatggaggacaagaactgtgaggactggaagagaaagcatgctaggggtaggattgcagaatagagctcaaacttccaggtcaatgatgagggttcagcaggacttggacactgggcatttgcagtgactccatgtctcaatattgtctgtatagtgaacagatgctttgaatgtgggagactagaataaatgcatttttataaagatttttgattaaggcattagtaaatagcttcagtagaactgtttacttctttctactgcaaagatatcccaagggtttctagccttcatcctcagttgctttcttaatagttaccatgaatatacgtaaggccatccataatttcacacctatacttatcatctcaaggcaagccttgttagacaggcataagctcataataaattacctgatccagataaggcttttttttttgtttccccaattacactcatcaaccacaaattaagattaattacatagattacttggtctgtaaacatttaactaccatcaatggtatgaatgaccatgttaaaggaatttcctaagtgcaatagcagagtactaccattccttgagtatggatagtcaatattttgtaaagctataaatacgggaatctgtaaagaatatattctgtatgtggagtccataccaaatctgttcaaaatgcctatgttaaatgtaattagtatattctgatttataatctaccatataaactcattaaaagaaacccacaagcagctcgccattaaaaaaaaaaaactgttaaattgatggaaatctggtacttattttttaggcattatgcagtgtgcttcattattatacacagattcttctcactatagtatcgtttctgttaaaagctgtgtgtgtcactcatacaggatacttacagagcgtttttaaagcagtacataaatacatgaattatttccaaatgtgagttaaattgcaagtcacaatttagttaagtagattagtgaatagaaataagtgatttattttaatagccaaaaaacaagcttaaagcaggtgaaaggcatagagcagacaaaggctaaattttatggagcatttgcacatttgcaagatttcattaaattttctcaacacaattttcctcttctagtaatatgggagactagatattctaactggtctttctactaattaaaaacacctaaaaagtcttgggaaatttgttttataaatgaatcaatgcaccagaaagaaagtaagaattctcatttgaaaactaaatagagaaataaaccttgagaagaaagaagaattctgaaacaggtttgaatttgaggatatcacccaaaaatcttgacttgcaaatttgtttgcacagcctctcagagtgcaggaaacaggaggacatccaggtccctaaaaagatgtgagttgatcataagtactcttgatgagctggaatgatgagaaggctacactcttagcatagctgtgagccgaaactaaagacaactcctttctccagctgatacaaggtaaattgtcgataaacttgaccctgaatggaaggtaaacacgtaaatacacagagatacaaacatacacacaaacctcccatcaaccctttaataagaaagaaaggaaaaagctagacctccctccaatttacacttaacgcatggtagatacagatatagacatggatatatatcacaaaaaacccagagtttattttataggcaatttacatacggcaaaaagaatacaaatctttttggagaatttcagcttcattactaaactcatctctagagaatgttactagaaaaatgagcactcaccagcagatttcactaaagaatcaagaaagaaagaaccatgaggaagaacttgcaaacacaagaggcatcagaaagaaggctgtttagtaagaacccgtaggaatgtaatcacacatggaatataaaatctatatttaatatctttaaaggaatgaaagactagttttaaaatatgatcatggaaaaagaaaacataagaataaacatgatgatttttaaaagaagaaccaagtagaactttcagatataaaagaaccagtggtcctgggtatgaccacagcaaggacagagctgagtgccttagtgaactgagggacctgaataaattacccggaaggcagtgcagacaagcaaggaaataagtgcaatgaaggacaacctagcacaggtggaagaaagaatgtgaaggatgaacatatctctcactggagttctgaaaacagaagtggcaggaaaatataaagattgtaactgaggattattgatgactgatgaatgatgacaattaatacattcatgaaaacatataaatactaaccaggatagttaaattaaaataaaacactcacactttaacacaccttatgataaaacgggagaacaccaaagtaaaaagagcattgtaaaaatagtcagcaagaaaagacagattaaatcccagagagtgacagttatatcaactgctaactttccaagagcaaaagtgacattagcagaaagtagagtgatgtttgttctgtattgttctgaaagaaaataactgccaacctacaacactattgcctgtaaaacttacaagaggccgggcgcggcggctcacgcctgtaatcccagcactttgggaggccgaggcgggcggatcacgaggtcaggagatcgagaccatcctggctaacacagtgaaaccccgtctctactaaaaaacacaaaaaaattagccgggcgtggtggcaggcgcctgtagtcccagctacgcgggaggctgaggcaggagaatggcgtgaacccgggaggcggagcttgcagtgagccgagatcgcgccactgcactccagcctgggcgacagagcgagactccgtctcnaaaaaaaaaaaaaaaaaaaaaaaaaaacttacaagacaggagaaacccagagattttgtccaagtcaatcctgattaaattaaacccaaaataggagtagagaaataagaacttagagaggactaaaatggaagtggggagttgagagcaaaaatctgtttacatgggtaaataaaaatcaaaataatacaaaaataatcatttatcttgggataaaacaaaactaaacaagatagactaaattatgccatatcgatacaatatagcctggggaaaatgtgaagataaatttcctaaattccctgtattgtttagggagaattaccagtttttaaattatttttaaacttaggtaagttaactgtaataaaaaaattccttgggtaaccgagtagtttttaaggaactgaatataatgaaaatacaacatataattcccaaaaaagtaatcacaaattaatgagaaaaataatcaaccatctgaatctataagtaagaacatcatataaaggtgggataaatagaaataaaaactaatattctaaaaataagtttagtatgtgaataattagaatatgtataaattaaataaatactccaggtaagaaatcatcgatatacagcctccagggtcttagaaggaaacaaacagcacacttaactaggacaacctggtgacagtacaatagagaaaatatttttaaaagtatagatataccctgttttataacaataagaagattctcaggggagggtatacaaaatataccacatgcactgccaatgaaagtgtaaactgtgtaaactttctgaaaacaatacaccccaaaaacctgaaaaacgtaatacccttaggtcctaagaaaagtgacactaagaaaatatgtatctatagacatgcttattattccatgatttataattagcataaatgtagcaactacttaaatttccaacaacatgaaaatagtatttaaaaaattcattaatagcatggggcaatactcatttcataaggcatatgaatcaagaataaaattcaaagaactccaactgattaaatagactccccttggccaagagtatctcaaggaaacccaaaaaactagttcagaccacaataggaagcggggttaaacatgcctccttatacccttccctttggagttcaggcatacaactgactgacattaatattaaaatagagatcagaagactgacaacacagactttttgtaacaagaagataccaaattctaacctgagtctggtatagcatcacatgacagatagcagcaggctttgaaggaaatcaaggtatatatagtatatcaaatgtatttctttgacatattttgaaatgaccctgaaaagctgttttttgtagaggaaatttgcagcccgtaaataatctccttcccttactagatattttctagagtctgacatcctttaaggtatgataggaaatacatatgatctattgtctctgaagcctgctacctggagacttcatccacataacaagaaccttggtttccataatcccccttatcttaactcaattgtttctttcttttcttttcttttttgaatttcaggctaagtttattttttattttttttttattccaataggtttttggggaacagctggtgtatggttacatgaataagttctttagaggtgatttctgagattttggtacacctatcacctgagcagtgtacactgtacccagtgtgtagtcttttatccctcaccaccccctattctttcccccaagtccccaaagtccaatgtatcattcttatgcttttgcatcctcatagcttagctctgacacatgagtgagaacatatgatatttgtttggttttctatgactgaattacttcacttagaataatagtctcaaattccatccaagttgttgtgaatgccattatttcattcttttttatggctgagtagtatatatgccacaaatatatacatatactaaatatacatactatatatatatataaatatagtatataaatatatctaaatatagtatataaatatataaatataatatataaatacatactatatattatatatacaaacatatatacacatatagtataatatatatactatatatattatatatatacacacatatatatatacacaccacattttctttatccacttgttcattgatgggcattcgggctggttccatatttttgcaattgtgaattgtgctgctagaaacatgcatgtgcaagtatcttttttgtataatgacttattttcttctgggtatatacatagtagtgggattgctggatcaaatggtagttctacttttagttgtgtaaggaatctccataatggttgtactagtttacattcccaccaacactgttcccttttcactgcatccacgccaacatctattatgtttcaattttttggttatggccattcttgcaggagtgaggtggtatcgcattgtgggtttgatttgcagttccctgataattagatgttgagcatttttccgtatgcttgtgggccatttttatattttctttagagaattgtctatacctccccttaggctccacttccaatattgggggtcacatttcaacatgaaatttggagtttggaaacatgaagtttggaaatatccaaactatataagcaggattatatagatacaataaagttcaatgtatttttcaaggcactcattatttatatatttatatatttatattatttatatataaaaataatatattatttatatatataatatatatattatatatataataatatatataatatataatatataatatataatataataataataaatattatttatatatataaatttatatatataaatttaatatgctatataaatataaatatataaataaagtatactccacaattgcctaatacagatttcttttacaaatccataggacacctataaaattgacagatataaaatgtgtttccatggtatttaaaagatttatgttatgcagataactgcctctgaaagcagaaacattaatttgcaaataaataacaaaaggacaactagtttacagatcaatgaatgccctcttaaaaaagtcttgggtcaaagaagaacccaaaatagatattagaaaatatttttaaaaaatagataatgaaaatatatattaagcctagtaacttacagtcagacagaaatggatttaatgcagatattagaaaagaaaatactaaaatgaataagcttggcatgtattgaagaagttataacaagacaaggaagaaaacccaaagacagaagtaaatctcatggtgaactgtagttcccataatccccacaactagtgggagggacctggtgggaattgaatcatgggggcaattacctccttgctgttctcatgatagtgagtgagttcttgtgggatctgatggttttataacctttgctctgcacttctctttgctgctgccatgtgaagaaggacatttttgtttcctcctcctccatgatcgtaagtttcctgaggcctcctcagtcatgctgaactgtgagtcagttaaacctcagcctcaggaatgcctttactagcagcgtgcgaatgcactaatacatcccatatctccttaaaatgtacaaaaccaagctttgcgctgactaccttgggcacatgtcatcaggacctcctgaggctgtgtcatgggtacatccttaacctttgcaaaataaactttctaaattgattgagacttgtctcagatactttctgttttacaaattaccttttgttctagaccactcacaagagtgaccatgcaaaatggaagtgtgccacttactcagctagaaacgctccttagcttttcctctcactgggaatgaaagtcaatattcttaccttgacctgtcaggccctgtacttaagaaaagaacagcatgctttgacctaaaattacctctgaatggtctttgtctgtaaaatggaagagacatggagaggcgccggcacccgaggtgctttctaaaataaggggtgccttaaaagtcgtgttgaagtttgtcttcctggaataggaagtgggtggaatattttaattagggaggtgatgtgattgaatttgtttataaaattatttttggttaaatgtaatagagaaggaatttgatacagtgggtaataatgaagaggaaacaattttaggaatattaaaatatcccaggcttgaatgaacgtagagatggagaaatgtgtaaagactgaagaggctgttgagagttagatggaaaagacaagtggacggattagtgttgggataagaaaggaagaaaggagtcattgatggggccatgtttcagaaggtttaggggtgaaggctgctgcaattcattgagaccagagcctttgaaagatagataagcatgcttgggtgcagtggttcacatgtgaaatgtcctacgaaacataaaagtgaaaggaggagacaaatataataaaaaatatatattcttgatgtcaaaactaaaatataaatattttggagacttttgtgtgtatttggatgctattctcatgctcttttttctggaaaaaataatacaaaacaaaaattatttcacgagttctcaatttttgtccttctgtttttatcagataaatgctaataactttcatatctttcttctcctgcagtttcccatgtcttccaaatttatttcacatcattatcttacttttcctcaaggccgttttttctcttgactacagcaatgcagatttcaattctgccattgaattcccagacatattcgtcatccccattttcatcccccaccaccctgccattttcttcgtgttaacttgttttcctgactcacagaaatcaccttttcctgtatacatttttaggatgtcagactttattctaatgatttctcctagttgccccccaaaattgtattctacrgtgtgattttaaagctgaattttcaagatgatatttcatatctatattttcacaagcttttcttctatgaatgttattgtcagctgtcagggtgtgagatggtacttgatactacattctttccaagctgttgcctgaatcggtttaagacaaagtcattactaggctgtaaactgttgctctgcaaaattgagcagcacgtatttaaccactcatacttcttagctctccaacactttgagtcaatagagtatacaaacacctgtaatttccagtgagcacagctcccaggctctctctctgtctctctctctctcttttgtttttttttttttgcctcagcctctcgggctttatttgtgggatttgcaccttcaccttctgcatgcagtgtgccatggctagttccccttacatttttgtcatgattttggtagaggcaatgatttcctggttgtagaaaaaagggcagcaacataggattacaaaagtattgctaagaaattgcaacaagctacttgcagtttatgtatgattactcacagtttttggatggtgcaacccttaatttctgaaccagcaggtgaaagatgagagaagaataagagacctttctatagatcttcaggcagacaggcttgttggcttcctaatatttcggtgggatactgggatgggttggaggcaacatactgtttaaataagtagacagttttttaaaaataatgaattgtgtctctaagatatatttttaccagaatgatactatataggaatatgcgtaaacccctggactttgatctcaagcaaaaccttttccctattatccctccctcttaagtgcatgagtttggtaaagtactacagaaatttgttctctcacagttctggaaactagaagtctgcagtcaatgtgttggtggggttggttccctctggagaatctgttctgtgctcctgccttaactttagggcattgccggcaacccttgacttgtagatgcatcacttcaatctctgcctgctccacaaggtgttgtccactgtgtctgtgtccagtgtctttgtccagtgtctgctttttcttctaataaggacattagctatatgcactcaccctaattaagtatgatctcattataacttgattgtatctgcaaacaccccatttccaaataaagtcacttttcctagggttaggatttgttttttttttttttttggtggagggagaaaggaaggaagtgggcacagttcaattcataaggaaccaactaaatataaatgccactgtggtaagatcagcttgaccatgtagatttttaaatggtggttttctttgtttctattgcgttttttgctcatcttatcagaaaatttgataactttagataataaatatgaaggagtaaatcattaaaaatttaaagtgaaggccaggcgtggcggctcacacctgtattcacagcactttgggaggccgaggcgggcggatcacctgagatcaggagtttgagaccagcctggccaacacgatgaaactctatctctactaaaaatacaaaaattagccgggtgtggtgacaggcacctgtaataccagctactcgggaggctgaggcaggagaatcacttgaacctgggagatggaggttgcagtgagccgagatcatgccactgtacttcagcctggacaacaaagcaagactctgtgtcaaaaaaataaaaataaaaataaaaataaaaaaataaagtgaatcccacagatttgcttatattctttataactagattaagtgtctacaacagggctctttttgactaactttatggggatatacaacaggtgccaaccactccacattccaaaagaaggcaaagacttgctttgcaggacttgcaaagaggtgtccaaaatgttttcctggccttaggctcagcatccccccgaaggttatgaaggaagagctgtggtctccccttggagagattggatggatgctgagtgctcatcttcttccccttccctgacagacaacttgatgtgcatccctggacttacagggacaaagaagtgtccgatttattccagaaaatatttaaaggatgagaggcttgcaaagaggcccagagcaaaatcaaagaaggctatagcctgaaaataattttattcccccgatagcaggccagattgcatctttcttatcactctctggtggacattgtgagacagagcttagccagggattatcttagatcttgtcaaagaaggccctggccaatgaggcgatctctgcagaaagcagctggaagtgcatcatcccagatcccaggttgagagaccagcctcaggagaacagctgaggttgagggattcattctacctgggaaaactgcatgtgatggataaccattcgtgggcagggatctcaaagaacccccaagtatgccctgaagaattcagcacccaacctcctattactttcaaaggaatcaaacaacggtttccaagggggcatgccaataactttactagtgccgtgctctccctttctctgtaacacctctcacttcagtcctccgtgagccatagtgtttcaagggtgtgtgatgaagcgatggaagcctcaggtctggaaataggaagaaagtttactacaagcggcctgctgattaaagtgggcccaaacttgtgaagaaaacttggatcaaagttggcatcttgattcttatggagtacacagaattgcaaccaataaaagagacaattcttgagaggaagggtgattagaggacattttgttacctgggagtgaacagatactttatgagaaatgctctatatttgattaagtaacagggatttgcctctcaaagtgggggtggttttaagtaggcagtctgtgggggcggggtaagaaaatggatttctgattttatctttgctcattttccaggttacgtaaatattaagaacattgttaatttactttaataaagaagttcataaatagtccaatattaaaagttgattaaataatacttttggaaatacatgaattttactgaatgccctctagccttactacaaaaagaatgctttgcaaataataaaagctaaataaaaataagccagctccagccactttaagtgacggaacacactctgtaacttggggatggggacagggcaggaaatgaagaaattaaaggcaagggcgcctcactgaggtatatcaaatcctattagaccaggtcatttccttggctggcaactggacagggctcctattgtcttgtctactttggctgaaatcttttatttatcctccacatttgtttcatttgcaggtaattctattcctgtttctacatttaccatgctggatcagttttttccctgattttatttttaagttactatgatattcgtactaaatatgtaaatgtttattattgggttttagctgtttctataataaagagttgtagttattgtaagttgcatcgcactaagctttaaaaatgtatttctccactgtagagaagtatgttccattgaaatttgattgcacacaaagcttgacatgaggtttattctctttgtgaaataaaccattcaatctggactgcatccacattcatctgaaacttgaaggaaataagtcatctttcacttatgttttaatatgccatatttctattaaattaatggaaggttagacctaaagctcaatgattggacacttattattaatgattctttgcacatagagtgcatggatagctcacaagaaaatttcaccaaagtcatcttatatatttctcataataatcctaagaggtagggttgatagacattagcattctgacatcagaattggagacagattcttctgtctcatttaagggatttgcccccaaattaatcagtccatgataaagccagctctataatattactctaaagaatattcaaaaggtcccgggcacagtggctcacgcctgggaggccgaggcaggtggatcatctgaggtcaggagttcaagaccagcctagccaaaatggtgaaacctcgtctctactaaaaatacaaaaaaaaaaaaaaaaaatagctaggagttgtggtgggtgcctgtaattccagctactagggaggctgaggcaggagaatcgcttgaacccgggaggcggaggttgcagcgagccaagattgcaccactgcactccagcctgggcgacagagcgagactctgtatcaaaacaaaaacaaacaaaaagaatattcaaaaaggtgcatggggcaaggagaggtcatttcacatcctcttgaggaacacaggtgactccagaccacaattctcctagatggccgggggcccctgctcccctccttttggttctagggacttgattcctgaagaggggtcatgcgccaacatctagtttagagtttttctattacaccacctggtctcttatattaatttgtttccctgatntttttttttaatctcctggatcacaatataatcgtttgaatttttgttgttgtgtatacaagggctcccaagaaatgtgtaataaaagtggttggtgggaaaatcttgctaacagaatccagtagattaataactaagaaaataaggcacacacaacaaaaggttgtgcatggctgcaagttcaagagtgggaactgattagagtggtagaataaatacatgtgcatgtgttctgaatcgattagacatataaaaagatatctagattctttgaaaaattaataagaaactttttttctaagcataaatatgaagttcaagtataaacttaccaaacaacagagaagtgataaagtgctagcataaaaaattagcatcatgattattctgtattgtttacatagatctatcaagtcaaatgttgggtcagagccattctttattcagttatcaaaatggtagagccatttggatgagttcagagacttcttctttatgataaaaaagataattgtaaatcaaaaaagagtttaaaggctatactaattaaacagctaattggaaattggaagatttgtttctccaaacttctactattttttattttcttttctgtttgtggaagttttggaaagcaacattttattctgtgattagcatcaaagagtttcaggcatgggttataggactggaccatgcatacttgaagtgtacttcaaaccataacattctatgagatttcgtgagcaactacctcttattgataaaaagaattgctgtttaaaccctattttaaagtacttactttttgctttctcaaatataaggatgatgtactatggattagtaatatcattacctatggaaacaaaagatataaaaatttactgttcactcacttctccttaatttccaagaacattaatcttgaatttaagcttaaacttactttaaacattatctttattatcttattttctatgaagaaaataatccaacctatctactagtatgccactttaaaaacattaaaagccagtggataactgcaaaagaagggcttttaattttatataaaataataaaataatttattctattgataattccaaactctcaaataatatcttgctgcagtgctaaggaaatggacaaaggaagaaaaaacagcttttcatgcctttcctgaaacaattgcaggaaatttttgtcacgctacaattattctttgatcatgaaaaattcttttaaagacacgatagccacaaccattttatcttctgacttactaagcagtctgagggtgaatagagagtttcgattccaggttatggttataattactaactgcaaaaatcctattgcctttcattaagtagttaaaatatttaattgagactacagtgtgtctgcacacagcgttgtaccatgcataattatccctacacatacaggaacactgagggtacttttaacaataaaacagatcatcaaaaaattacatttttaatttaagttttgactttaatcttctccgtgattaaatacctatctctgcattttttctgcaaatgaggacattaagctaaaacaaatgaaccataaagtgacgggaaaaaaaactttgcactgttaatataaatggataaatctttaatatgtattaaccattgcactatgtctttattttctaacagcttgtatgagaaagaagaactggtgatgcagaaagtcaaataccgccagcttagcgggtcagcatcctctcctcccacataagcagagatcggagcatgagataaaatacctggatgccctttgctccagcctcgtgctcccacaactttgcttctgacagagtacttatctctctgaccactgggaaactgctaaaagagagaaacttgaaaaggattggacttttctgtgcaaatctctttgaaaattgccacctccaggttagcttttaagagaagcccaatatattaggaacctgaaaataaaggaaagtttgcacattgaaacatcacttgctaatagttctattattggaaacggaaatatggaattctagaaaaagaaatgtcattatggggttaggaattaaccacttgctacttatgttaatgtgacgtggtttaaaaaagctgcaggaagttcctgaaattattgaaacaaaaataaagtattttcccctggaatctaagtaatgtaagtgaaattctttaaacattctcttcaactttatatttcaaaattgcttcacagtaatttcttatgttatccatcacttgtctaactggaaggcaagcatttttattgttttagttactatttagctttatgaacagcattcttgctttgttgcaattacaaacatttatttccatagggatggaaagattatgctttgctctctctgccaggtaccaattgtcaatagaaaatagagccaactagagtaactttagctcttcaatcaacacatccagtattaagaaaaaaaatacattgatatttgagacgtaaattcaaatctttattcaatacgcaagaagtgtaattgtgggagattaggttgggaaataataaaaagctgtataattagagtgtcaggatttacaccctccactggaagctactatatcaggtataactccgcaaaattgtagatggttggcaactaatccttgctcacatttratgatctattactatgtgccaggtgttctgtctgaaacagcatgggaagaggaatcagagacagaattgccacctatgtggggccttgctggggtgcagaaattttgtttctcacatttttgaaatgtaatactttgatctgaattttactcctgcttaaggacaccaagatgaaagcggatggcaccctgccccccaccctggtgtagtttgttaagaaatgactttagttctatgaaagtggattcttagttataaacataaagaactatcaccggctagtaagaaaggattttattgaaaagatgttgggagttcatttatcttcagggattctgcagatgggcagagagactagaaaaccaagagcacgaaccaggcataattcaaacttcacaacagtgagggtaccagaacagcttctagggaacaacgccaggcacgactgcctggaagttgctggttacgggtgcttgattgtcactatttcctggcattgccagctgcagaggcagctaactaacagagccaggggtgcatccggggctctctttatgggggcatccacagtgggaggtagtgggttttgatgcaggaaattactgtgttgtatcttgggttttctcaatttatacaacaaatgtatacatacgttcagatggaagtaagaagtaccacatctgagagcggaagaggcactgtaatcacccatcccaaagaagatgatttcttaggaaaagaagtgagtttgggaaatatattagatgtattctcctgtctcttccatattcttgggaatttgagccatcacttatctctgatgtgccttgcttgagaagtggtttctatactatatttgatgatgtggatctgataacacaatattcaaatattttccagctgtgttaactgagtctctagaggcagatctcctgagaattgtcagttgtgtttattttccagttaagtctactttcagagagccattattgaaagagaaaagtttcaacagaaagatgattattgttaatattatcgtggtaagaccacttaatgtgagatctatcctgttagcacatttttacacacccactgttgtgttgttaactataggtgcaatgttgcacagcagacttcaagagcttattcatcttccataataaaactctgtaccattactgttgaacagcaacttgccatttctccctcctttcacctctgcaacagaatgataaacctggagagcattatgctaaataaaataagccagttacagaaggacacatattgcatgattccacttatatgaagtatctaaaataataacgcttattcaaatacacggtgggatttttactgggaaaaacgctcgctctttttaaaaaaaaattgagagagatttgctttagttgatcaaaattataagctaccggaaactccccaagatggcatattgttgaagccatagtgtgtgcacaggtgttgaataggcccttcagagataagaagagtaaagtgtggtataaaaaagagaaaaagtgctagaatgcagtcattgcaacattaaaagaaatgctttatcttgggggagatcctttggccaaactatttcaacttggaaagatgtagtaatataaaaagatttcaatacaaggaaataaagaaattgcatccgtgctacttctcaaaagagtaagaatttaactgataaggttaattattataaaattaacttttaccatctacattaaaattaggaattttctgagaatttgtattctttttgtcctttcaataaagractcaatatgtttaactctattttaaacaggaatggctgcctatgtcttgcagtttgaatgcaagaccctcaaatgctcaggaattatcaagtaaagtttatgttaagaaactagcattctgttgaatcactcaataatggttattatttaggatatgcaaaagttaatcacaaaaacttagactgaaagatactgcttacaattataggtgggaaataccataaaatacaacctttatttattttggaactcgttttaatgcagaataatcctagcgctctatttagtaacaagaagaaaccaatttaaatatcatgctgatttaaatagtataaataataaaaatgacaattttttgttaattttcagactctacatagctatttttgtctcttctattcttatgaaatattcagggaagatattattactttcactttacaaatgggataactgagaactcaataaattgtataatttatctcaagacacagagctggttcatggtagagctatcatcagaaatctcacgattattagttatccctttccaattctgaagtcctctgggaagtgtcagaatttacactcctcactaggaactactattgcagttggaactctgaggctttatttgggagtttttcctgattacagaaaatctcttcttaagagaggttttaataaacaaaataagtcggggatattaccagatagcccctatatcctcagagctcccagcatcacaccttttataagaacagtatagaaaaacaaagttccttccctcctcctgccctgtgttatttttccaaaaaacaaacaaacaaaaacctaactacacactaagtgtgaaagtgattggagtgggggaaggcaagctggggctgtaccaggtcaagggttgaaaagaattaggggattattacagttctagttcgaagacaaacacttttcaatgtatgtcaatgaactttattgaacagccgccatatactagtaaccctcttaggtgtgttgtacacttacacatcgaaaccagggtttcccagatttcttatgatgaaacagatagaaggtgataatgctggcacagcacacatggacagtgtgacggaaggagaccaattaaggacgangcgggtccgtatttctacacacctgccaccagctggacggctgtgctggaagtctaagccctggatgcttagctgtgtgatctgtgaaccggcagcatcagcgttcccagggtgctggttagaaatacacctctcaggcccacccagacctkctgaatcagaatctgctgtttccaaaattcccaagtgattctcatgcaccttaaagctttagaaacactgttctaattagtgttcttaaaatattgctatgggatacaggctttagtaaattctcaggatattctaccatgtactcaagtttgagaaacaggagatttaataaatactgatgtttggatcccatccatagagattctgttttgattggtgtagggtgtaatctggcattaacatttttaaattgcccctggtgagtttcatgaatggcaatgtttgggaacacctgctttaagttaagccatgagctaattgttcttcatcatattgcagatgtgggaactgagacgttataaggaaatccaatttgcgagtggtagagccagacttaagcttagacccttaactcacttattctcaaaactggtctgtgctgtttattattttacaggagagttctatattgctatgtttaatacattagtatcatttaaatatattttaatatatgcccatgatggataatactgagtgtccacttgattggattgaaggatgcaaagtattgatgctgttgtgtctttgaaggtgttgccaaaggagatttgagtcagtgggctggaatggcagacacaccctttatctgggtgggcagcaactaaatcagctaccagctcggccgggatataaagaaggcagaaaatcatgatggttaagcaaactaaatatggcctgagaaggactctgtacttctataggtgagtccttgtggatgaactgtaacctagcttaatagtcagacaaaatttaaaacctaatttaatagtatgcactgtaacaatggctgaatgttgcccagtcccagtgggattcaaccactcatagactgcttttgttcaaactgcgttcaaataaggcaaacgccgagctggaaccaatctcactgtttctgtacctcgcttctaattcctgtacgtcactttaccttttttgtctataaatttattctgaccacaaggcacccctggagcctctgtgagtctgctgtggttctggggactgccggattcgcgaatcgttcatttctcagttaaactcctttaaattaattcagctgaagtttttcttttatcaatgaaaagactagactggcttagccttccagcctgcacctttctcccatgctggatgcttcctgcccttgaatatcagactccaagttcttcagttttgggactcagactggcttccttgctcctcagcttgcagatgccctattgtggggtcttgtgttcgtgtgagttaatacttaataccctctcctttatatatacatcctattagttctgtccctctagagaaccctgactaatacaatgtctccattgaaaagaaaagaaaatctattaataaactgatatagtcagagcccctcaagaaaaataccaaagaaactccaatgttgtagagaattattttattgctctaaagacatcaaaataattacatgccttgtttacgatgcttttaagttgatcacattcaaagatgtgtcctatccattcatgtacatacattcaatttcatattgactcttgcctttttcagcagtgatcagtaaaaattatctaaaaatcaatcctgaaggttatactttatttttccattttgaaccttgcccttgaaagatcatttatatattttaaacacatttttaaaaatgaatctccagaagtctaatttctcatgctaaccaaattagagaggttaattcgatgacgaactcttagaaacaatcatcattagaacttgggtattatttcaaacgcatctctcttccaaatcttagcagttgaaacaatttcacaggttaaaccagccagcttgacagcccgtgaatggctactcactaaagggtccaagcagaggcaaaatgatggtcctatctcttaaagacagagcaacagaatatttggaattaaatagaactggacttaaatctcatcccagtggacaactgggaaaacttggaaacattaatcctgctgaatatttgtgcatcatttaataactaatacatactgaattaagtagttagcaggatttacaacactgtgtataaggagcctggcatgtgtttcctgatctttggtgtttttagagttaatattatgacagtgtgtaaacttggtgtcgagaattaaaatttgcttaacagttctagtgttctgtacactgttacctatgttcatcgcctccaactcattgaggctcatgatgctaaggtgaattctggattgaaatctaggtctgtctgcttatagggcctttttccaacttcagggtttcctgcttttgctcaattgatcctttcaaggctccatcacgtttgagctacagcaaatcatggtgtccactgttcactgatgggctatgttccagaagttgcaagaaaagtaaagggggataaaagaagagagagagagaagacccataaatattctgaagtatatgactaatctagtataatggaagctcagaaaataaattgtatttccaaatatatatttctgaattttttggtatttgttattggtattctctgaagggccactttcttttctttctaatgctctatgtccttacaaaggaatgactattaattcactggaataagaatcacactaattggcacacagtcccaatctgcttggcatgtcatttaatgtgcagccatttacctggtcaagtgaatacttgaaaattaaacagttttcttgtgctatgattgatggcaatgcagtctagggttaagtcttaaacgtaatcccttataggatttcctaggttctccctcagagtttctaactccatagatttgggggtgggtcccagaatttccatttctaacacgttcccaggcgatgctgaagcttctggtccaggtaccacactttgaaaactgctgttttaatgcttacatggggtagcatgagttagttttgcctggggcttttaattccaagttctgctacttaacagctgtgttataatgattaagttatgtgatgtctctgtagcttgatttctttgtataatgaggaaaataatcattcccttttacataagattattgtgagaatttaataaacaagaaatttcttataatgcctggtacatagtaatcactcaataagttatgtcaattgtcaaagcacatgtctgaattatagatgagagagaaatattgtgaattctatggcactttaatggcctgttctctctacccatctctagccgtaccttacactggcttatcctgtgctcttcctttcctgagggaacccaaccacatatactgcctaaagcactcttttggcacttctaacataggtgcaaggaggaaatttcaagaaattatgacaaactacaagactcaaatctccttttaaattttaaaaatcaaaacatgtattcatatcccatggcacatatggatgaagatattgtttttctcagttaatattttagttttgcttttgtgccagagccttcctttttttttgtaaatgtcccttatcaggctactgcagaattgcacaaatactgaattgccccaaaatatttgcctttaatttgtttctttaaagcaaatgtaaaactacaatgggttatatttacctagaggttttatcaccatacgcttaatttaaactcatataaaaatagaattagttatatttagtcttattttcatcattcacttaatttaatataattcttagtccataacttagatataacaaaaatttgtattttttctatcctccatttgccctaaatctccttaaacaaaacaaaacccaaggaaacaattttgcctggaaaacgtgaagtttgattagttccacctaccttaatgcactttaatttgggccccttctcctcggtagtctagaatataaactttttttttttttttttttaagagatctgtttggaaaacctaccaaaacaagacaaactcaatgatttccttacagagagaagcctggggaaagaattagcaggaatttctcaacgggtgccgctgctactagttttttatgcatgagtgcttgtcatttggcagaaatcaattgttctctttacaccacaagagtggtggaaatgggggtaaaactgcaagttaagactgctctgaatgtggattcaacacttcactgttgtcctccaacatgcgccctcaaagtaccacttggctgggaattaaaaagggttgcctttagcaaagctttaatttaaaatagtcacaggtgacagckctattatttttgcacgttcagatgcagccacagctgtttttattgatctcagctgcatacacacccatttgttgtaattattagtttctgatgtagctgaagatacatatctcgaatgcctatcaaggctaaattaaattaaggaaatcgtacttttcaccttcaccctctttggtcctgctttgctgcaggaaattgccacaatgtaaaactttgagcctcatttcatctccccccactaggagtgatttccaaagttgtcctaggttcctgatctattccaatttaatagttactgacattttttccctgtatatttaacacactacaagcaattaccatgtgrcaattatgaatttaaaaattaaaaaaaacacaattattgctactactgattaaacattgttaggactttgaagaataaaaaagtgaattcaacctgccctcggctttctaaaaattgcctttttgctcttaaaaatgcatgtacagcttttttcatataaaaataatttcgagtttcttctatacgcataaaatattttcagctatttttgatttcaggaagtatgaaaaattaagtatacacaaaagaattgcggcatgacccgttcgaactctgtctcagtgacagacagttttggattgtagacctcactttgttttgcgtatttctgtttgttgtttcacctgtggtccattcactgtatttgatgtgttgcaaaacaatggcataacggtgttcccaccagtaatgtaagaagaaacatggaggaagcaagtaagggtctaggaaatttgggagagaggaaaagagacataattaatgaggagagggatcaagaagattggcaggatttttagaagggaatttgatttgcaaggtacccagaacatggcacacaaaattgtaagaaaaacaaatttttcttgaacatttatataaagattcctttgggaaaatagaacaaatttggttgtagagtggtctggggttgattttaaattggaaaaacacagttttgtttttttttaatttgaaataagagctgatatgcaatattgtaggggagttggttgactttttagtcagaatagtggcttttacaaccatggtgacaacattaactgtggatcctcttgacgtcttcataagttcattaatgctgggggaaaatatgcatagcaactaatctaccaatatttgagagaattaggcaacctctcaagaatgtaggaaagaaatgtaagtcaacaagcttatacaatgtaaaaaccatgaataggcaggtaataaataatagaaattgattttttctgtccagtaaagaccatgaaaagagaaatattataattttaacttgagtgctctagaatactgggtttgtttttttaattgattaatatgattttaaaaaattatcatgaatttaaaaatattttctccattactttgagttatcactttaaacataggtaatatcaagatatgtttctgaattatatatttaattatgaccactaaagagcacccatgaaatggaagtgttaacagcaatgttctgttgtaggaagataatcatattggttatgtctgctttatagtaawgttattgttgattgatttgccttttcctaacttaagtctttttggtcttttcttctatttgttctragagaccctgttcaaagggacattttattttcctttgtacaacagtatttgcctgacatttactctcctctaataaataatattaaactctagtcctaatacatttacttacctaaggaaatcggccttgtgatggacccccggaggtgagatacatttctggatgaggatctgttgagaagttgagcatttgttcagctactaagtcactgccaccacctygttagctaaacatactctgtgctcattccttcatcagtaaattttggttgggacacatggcaggtgataatagaggttattagctgcaatgcttattaaaatatttgaagatatactttagcacattttaataattattgagactgtcccttagtaacagtagctcttctaaatgaaagcttttaaaattgcatgtaagtcaaaacaaagcattatttgttattcaactttatataaaagctgtccagtgatttcaaatatgtactaacatttaatttcaattcaaaataagtatttttatgtttttataaagtgattaaatcactttattgaattctatccctttataaatgaataaaggaatgaactcaagttgtttctattctattagcctttacttttcccttcccccaattaaccccaagcaaaaatgtattgactttgacctgagaagagatacgtcaattttgttatttattttgcctctactcctatttcccatacatatatgggacatatatatcagcacaaattagcaggcccaccaatttcttactcttggatccagtctgatcnnttctaactcgtgaaataaactaccatgcagcacggatgatcattcaaattacagcttagggttgatcataatgtcttcattttagtatcccctttaggttgacattatttattaaaaaggtagttttcaatcggatttatggggcattatcgatagtaagtctacttgatacattgcacatacctttcttctgccaaaaagaagtgtttacaaaaatgtatttgaccaaatactttacggtaaacatcacagtctgaaagggaactatcttctttgaaaggattaaagcctccagatagatacaaataagatttttttaaagtagacacatgttaaatcatggaacagcaaaggggatactttatggaaatgaattcacaagataataatttgaatttgacaaggtgataattaaagtccccagatagatttcttccacatctgtatgcctttcagtaaagttggttagcatattaactactgctggagaatacagaaaatattcatgggatgtaaaactgcaaattattattcatttcaatttgtataataagtgtaacaaaatgcagtgcatacagtgttacacaagaggtaccaaactccattatagacatttttagagcaaacgtgggatccttatatgacaatttttgtcttcaaatattcaagacatttaagtatgaattaccactttttgcaatttaaaagaaattttgtttatcttcaatgctttctagggctaacaaattcttacttcaaatgactagaatcatttttaaatattatgtactaggatatgtggatatgaacatatatatttatacacaaatatatgtacacagccaaataaacaaataattagtgtaatctatatgtattaatattgntatattttcctccagagaaaaattgaggtttgctgaccagagaagaagaaagcatcaatgtgtgattaaaaaaaaaatgtatatatatatatatccactacatttctaatttgaaatagtgatcctgcatactaattctcttattcataattgagtttcatagtacattcattttaatttagacatttatatgagaaagcatgtttaatatgatgataagaaactgtatgaaattttgggaaagaactgttaagtgtgcccacacactgtaggcactgaatgtcacacttgagaatgtccctggtcctagcttatctataacaggaatattttccgtcatatggaatttaaagataagaaatgaatcaccacgcagagagatgtgctatcacatcccatctatggaaaaaacaaatgaaaaaaaaaaaaacatgaagaaagactttttgaagtgcagcatcacctgcatttatgatattttcagacatataaaacaaatattattctcatggttttgaataaaattgtcacttttaaaatttgacatgggatatcacaatggacaatgcagggacccttcagcccatagtcaacaggtgatcaattgtgaaaactgatattctctattaggaaggttagctagagtaggagataaaaaacaacatgattacaaaaaggaggatcatttgagaccaactttaatgtgaaattgtgtagaaatgggggaaaagatacagaaaacatcttcacaagtccacttgagaaactaagttggtgcaaaagttattgcactaattacttttgcaccaacctaattgtaagttatgcttgaagaaacttaaaaggagagacggagagagtacacaactataaaagcaagtggaacaagaagtgaaaatgaccaaagaacatatttgttgaacatggccattttgacaatcaagggagaatagtaatttaaagtacaatgccacaatctggagaagactgctcttgcacacaagtgaaagctctcatcggtcctgtctgatgcaaattacaggtacattgctgcacaggtgtcagatcgcacatagctgggctggcactgcctctcctctggagaggaatgcagcacattctccacaggcgactggaaagtctggattctgtcatctagaaatacaccttagttatccccttggcaaattaatgggaaaacaacctcttcacttctgtgttttagaatttctgttttatgccttttcattgtttcatgcaattttattttttcacgaggtcaggcacagctaactgttgattttcaccaaattaccttgttattggcttggctccatggagcagccccttccaagaaagtttcccaagaaactatgtacttcttctacttggactcagctgtgtacctatttctctcgtcagccattagagtgttccactaatatagtcaaagcagaacatctggcctattatataaatgaatattagttttgaagaagatatctttggagacagtagaacaaaatggattttttttcctacacaggaactcttggtttttcctcactgcccattgtcattttttctaccttactcagaacatgattttccctcaactgcacctttctgtaactttgacctgtgccatccttgtgaaataagtgatatgtgatttattttaatttctccttctaagtgaacatgcagagtccttcagagaccatctgtgcctcctgctgagtctctgtgttttctacccgggctagcttcctccagagcccagtctcaggtagatctgaaccacacatggaggagattttaagaacaagtcttgtgacacttcctatgctttgggtccaaaaactattgattttcttatttccctgcaagtgtgtcagattctggcaaaactagcttggagtttactgagtttaatgatactgaatgacatcaggactcactcttctcttttcatttttttgctatgagtgggaaaaaatataactgtataagcaatgtactttttttcttaacgcaatttaatctttactaaaattaattttgataatcatatatgtacaaagtgtttaattttgttactttttaattcttagacattgacttttaaaaatcttaatcgttgctattttcacccctgactttatgcccagtgtctatatgcataaacacaaatctttctactcctatctgtttagcaaaatgtaaataaaatgtctttaatttatttcaattttgtgtattttttttaaatttacttgcctgggttgagcatcttttagtatatatttcattgtgttttactgaaaatttgacttaagactcagtgtattactgtcaaactctcccgtcatgactatctcaggtagctgaggtatcactgacagcataagcagcgacaaaccctcgggtaatgcaaattggcatatccgacaaccccaagctaacaagatcataaccagggacttgcaaacatgtttttaggacataaactcatcttaaggttttacttaaagtaccatccatctcatctttaaccagcctctcctaatctttgcagaattgtccattctaatgcagtctttcttcattctttcacccgtggctccattaaacgtttttctgcaggtagcctctccattggagtaactggactgaggatggactcctttcttaagaaatccagaaaagcaacaaaaatctttccagttactactggaaaatttctgcagtcatcatacatgtatcattaggttctcacctaccattcctagagtctatctatctatttacctctgaggtttcttagattagccaaacacttttgcagctctcgtatttgcattgtagggccttggctgagactagatctcccaatatttggatatattgaggactggaagtaaagaaagactgccacttcacacctatggaaatactacctttttccatagaggcagcttgaatacatgattaggaattcactgtgactttgggttagaggaaaaaaaccaaaatgggttatttggttatatagagaaggaaggaaggaaggaaggaaggaaggaaggaaggaaggaagaaaggaaggaaggaaggaagagaaagatcctttctttttccccccaggaacatggcagtttgagaaaatcgggaataaaacaagtcttataatttgttaaatattgtaaaatactttccttattgttagtagaattccatcttggcagactatttcttctaggaaaccatttacccttctccccttctctgggcactacatttctctttctggtaagaaatctgtcaaaggcacttcaccaggaatctggctcttataaaatgcagtaaaactgcaggcaatggggaaatgaccattactgaaactcctttggagacggcttagcttatgaagtttttgagcagttctacctgatgaccagcttactatgctcatctttacttcctcctgtaacaggatgactgacacgtctcctctttgtcatgtgaccttgcagagccttcaggaatttatgtcgactgcacattttccttggccagtggctctggtcttggccattgacttgcatcagtcaacagaaatgttgcagacctaacatgagcagaggctctaagtaaaygtgtgtgatttggattggcctcctgtgcttctgccatttgtcggagcaacattattcatgccgccacaggtccccaaatgagaagatgcatgcagctgatctagacttaagctatagcctagaatcacatccagcccatcccaacagacccagagtgagccgaaatcttcccagcagtttcaagagcagggaatggctgttgttgcaagcctttgggtttcctggttatgtataaagcagcattactcactaaaaacttcataaatacaaagctttctgcatgagtttctattctgtgccctgcaagcttttattaaaggcatgtagagtgaaagtctgattttacctgaattttaggaggtcagggccaaggctggatgcagcctagcagttgtgctgtgccatgggaagggacagcatgtgcccccaaaaaaagtcagaacaaaaaaacccacaaagtttgagtgtggaaaagtgctacaggcttctggaatcagttggctcactgaagttcaagcagcaactatgaaaaagttgtgggacatattagcattttatagggattcttagaaatacctagggagagaaaccccataaaaggctagattttctgccataatacacaaagggacacaggctattggtatttaggcattaaagggaagtttgacccacccctgaaggctgaataagtgtgagacacctggtttatatttatataaatttttgcacaggacaaattcaaccttctaagcacaatgcaaagtagcatatccaatctattaagcaccatgcctcttaactcataataaatagcatatagcaatcctgccacaggcgctaacatttattgagtttttctactgactaggctgcgccaaaatatttttcaggttttaactcatttactgcttcatgagataaattattttactatcttgattaaacaactaagtaaagttttgtttagaagagtttagtagttacaccaaaatccagcagaagaaaatgactgtaatttcctatataacaatcctttgatagtttttctttatcccttctccttacatctgtgactaacacattatacttccttaaaataaggtgggagccagcatttataaaatatatgcatatagagaaaactaacacatacattaaggagaggtggagaaaaaaagaaagatcatatataatcatttatttttatgttcatttatgtaatttatctatgtatataaatgacttacaataaaaatgagtgtattcctagaaataatagacaacagggaattgtattcttggggtgaagtctacaatggatagatggaatagttgtatgaataacatttttgagtatattagcttatcttcaaaatgtgcttggtcttgtcatttagattatattatatccatgtatataaagaataatgatattaatatactcttactgctaaatttatacattactaaaaataaaaagtgtcatatatttgagcctgaggacttatttgaaagtcttacatgaagaatattagaaacatagggattacgtatcttgaggatgaaatctgtataatttctacttcagcaaatcttgaaaagcactctgatatgtcatctattgcctaataatgctgatcatatggaaactggatcaacttgcaaactggatcaacttgcaaactaatattacatgtagtaatattagtttacttcaattatctttcctaactctcaccttgaaagtactccactcattaaactatgcatatacatatatatatatatatatatatatatatatatagagagagagagagagagagagagagagagagagacaggatctagctttgtcacccaggctgaagtacagtggcacaaccttggctcactgaaacatccgcctcctgggttcaagcaattcttctgcctcatcctccccagtagctcagattacaggcatgtgacaccacaccaggctaattttttgtatttttagtagagacggggtttcaccatgttggccacgcttgtcttgaactatggaactcaagtgaaccggcctcctcggcctcccaaagtgctgagattacaggcatgagccatggtgcccggactattcttgtactttgggtgtctttttttttttttttgagtagtcatacagaattataaagtgattcacaccctcttattctaaatgtgttcagtctaaatgcaaaagttttagtataaattaattctgtatatttttatttaattttaagagtggagagatattagctaataaaattagctttggaaataaaaagaacagatacggttatagttcctttccccaaatgttttaaacttacaaaagcaattaagaagcagtatcacaagatttaaagtttttaaggatattattttgttccctaatagactacacaccgtcaatagttaaagttcactaaaaatccagaagttgccacattaggctgaactcacatttattatttctgttattagcttaacttatatttattataggagggatgacttctttttacaatcatttaatatgacaaataatatattacattttgatttaatgacaactttgtgctttatctaaaaggtagcattatttttgtgtgtgaattaatctatgttccaataaaacttccaacataagtaaggctctgtatgtatgttatgttctttctatatctctggattatatggatttacatacttgtatgccagtacatatgtacatatgtttaagtataatatacatgtctgagtataatatatacattcttactgtacaaactatgcatatgcatatccatattgcatgcagctatgtagatagactctgacagcatagaaaaattttaaacttaagcaaagttgaatagctctcaagtactgatatatgtatgtgtccaatattatgattccaccattgctaatgcacacaaaaaaaactaccaatttatttttcttatataattatatctctgataaaattattgtttattcagaaacctaatatcgaccattaatrttccagtttcagaaaacaaaaactcctaagagaatgaatagaaattttcttaaggaattataaagaaccatctcagaattttactctgttactgcaaaatctcatgcaaagatraccaagtacggtatgtgaacgtctcttcttctaaagctcatgaaactgctctctgattcctctagcgttgacaragaatctggagttcagtactcyatttcattcctggacatttagcccattattcttgtatccatatttcatattttcctttcatgggggwtaattgtaagttaaaggtgaatttgttgactcaaaccttataaggaatcatagatcaacctaaagatttcctaaaaatatacctacatattgaatacttgctttgtctaagctgcttaacaacaacagaaaaaaacaagcaaacaaaaactcaaaaacaaaaccaaaccaaatgaaaacctgatggcccaaacttgtaaagtgtattttcttggttaattatttaaataacaaatatgaggaagaaaggcattctagtgaatctgctttaaattacataggagagagtcttatgtaaactaatgataatgaatatgttcggagggtttgtatgtggagggctttgtgttaagcactgtgaatactttgttccatttaaacgccaccttagactctacaaagctgagagagattatgacagttgaccaagattacacaatgagaaagtaagagatagaagtggaacttgatcacaggaagtcacttctaaagactcaacatttgaccctggtctctaacgcattgattttgagcccagcagcatgtgaatttattcctatcaggataaatgaaatgcaagtaacttatttaayttgagtctcagatacatccaaataaaaataaatgccctcatttatagcatcacattctcagtactaagtaagctatctataatgatacaattccattgaggcagaagacttcacttcatatctacacgacatttcattctttctttctatttgttttttctagaagrattaactgaaattcatcccaagatgaggcatcttggctgaggtgagatatgcaaatcatctgtgttgtttgacagtcacgggtagataaatcatatcactaacaaaagtcagttgttaaaacttgaagcacawttaataaaaagagarattctcccagtcacacaggccaggtgggtgcatagaaatggcattttatcacttactgaccagagarttgcaaatacaatcccatcacctaaaaacaaggaaacaaaacaataataagaaaacttttttttttaatttttaatagaaagtcagttttgcttctgagtaggtattktaaaataaacttatgggttcttttaactttttttgctttaccttactagacactgagttattattttttgaaggaaagtgaattataaatcagaaattattttctctttttgttaataaccttaggacataagaaatacatatttccagaggaatttatagaaaaaataaaagtaatgcttccattattagtattctccctaaaactatagttagaaattataaaagtagggaagggtccatcaatagtattgattgaaaatgtaatgttacatgtatcagatacataaatccataaatccataacaatggcaaagggagacatcattactatttggataaattaatatacttgaatattttcccacataaattcactaactattcaaaaaacttcacaggacttttgaatttccgttgtttgttttactgattatgacagctcacaaagcagtatgtgtaactttcaataataatttagtgatgaaatattaccaaacaagaggagagkattttgattacctatggtattagtttatatcattgtgtaacaaatcttcataaaaatataattcataaaaattatatttcataaaaatattcataaaaatataattttataaaacatattaccacgtgttatcagctgggtcccagacacagagtccgtcagaktccagtgaagatgttggccagactacattgtcatcagaaggattggctgggaagaatctgcttccaaactcattcagctttggtagaagttatttccttgtggttgcatgactggtctttttgctggttgtagttgcaggtccacattcgttctagaggctgcctgcggtcyttagaggcctcatagkcaaggaactcatagtttcttgccatgaagacttttccaacatggctgcttacttcttcaagcctgtaaggagatcyrgtctcagttggccaggtcttgtgaaaggtaacctcatcacykgagtcaagtgtcatcacmtttcccatgttccattggttagaagtcccagctcctgcccacattcaagggtaaggggttatacaaatgtgtgaccaccaagaagtcaagattatgtgggtcacttagggtctaactgccacaactacatatttggatataatttcaaagaaagactgtgaaaaagcataaagaattgtrggaattgcctgagaattgaggacgttcatctgcaatgcctgtmaggcttacattaaacaagtctagcttactgagaaagttttaaaaaatgggtttgtatgactttacttattgggagaagccatttgacttgtctttgaggggaaaaataatttaaaaatacagatatactctctctgcaaaacaattcctggaatatgatctaacagaaaagcccagcagacctgattcaaacctgatgtgaacacagaatgctttgaaatgagtaaatttaattattaaacctaatttttcaggtgaggaaactgaaacactggggttaagtatcttttgcagggtcacacagctaaagaattttggagcaggaattcaaattcaggcagctggcttcagacctcatgctattaaacctgatattaaacttgacatccatcttacatgcaaatgttactctctctatcaggaaaataacgcatttataaaagccagctcagatgttacttccaaccaacaaatttcctggacacactaagtaatagagttaatcacaccgtcctgtaagtactacccacagtatccgggctctaccacattgtaatgcaataggtgtgttcacactgtttgtctctcctggtgaatcgttaattcatcagagcatgactgtgttgtgtgtcccattatccttagtaaataatgtagtgccttgtgcataggaagaaattaatcttgatggctttcaagttccaccccaaacagtcaagccatgttgattgaaaagtatcttctcagtttgagagattaccatcagagtatttgaaacaagattgtatccttggggactccatattgaggacattttcttcataggattctaaggtctaatgacttggcctgatcctaacctaatcctttagaaggctagagaataaaattaaatatgtttttcacttttccagtggagtaagcagggttttattgtgcttcttgaatcattgtcacactagtaatctcttcaaaagcgaatttgttctggaaaataatgggttagaggcctctgtggaggaatacagtagtggaatattttgaaataattgtaaagcaaaacagataattgcgtttttaagctctttgaaatatatacgtaagatgttatgtgcctgaggttgaacaaaaagataaatagttacagtcattacccaataatgtaccaattacaaatagcattgtgtgtacatgtcctctattataaaatcagaacgggatgaaaaagattataatcacgttaataatttgatttgcttcattcatcttttgagttatcttttcataaaattagatactgtgttatttccttctggaaagtacaatggtgcatgtgaggagaatgttttcatgttaatcaatgctgacaagaatattacacttaaaaaacacagaaggcaggcaggttgggggttggaggacagacaaatgaagaagaccagattgaaattattagttgccagaaatatatctattgactttttacatttttagaagtacctctgttagcttcccaaaatacagctgtttacagtgattgataagttcccgtgcttttaagcttattcacatccattagttctgcctttttcccctgttaaaaatctgaagctgtcacattgaagtagcatgatcagctaatgttcctgccagattcaaagcatgtccccaggggtggcaaaagtattcaaaatctcaaagaaatggctttttaaatgttgcctgttgacattggtcactccatttgctgtatcagaaatgttgaaataaatatcaggcaattatagaaacaggactttgatgatcaattttctataaatattttatgtttagcccaaacaaaagaaggcatttggaattcactattttgtataaaacttttattttaaaatagtatgtagtatattttcaaaattggttaattaattttctagttttcacttcaaataatgattatttactctattccctctagcattagattattttcttgcaaaccgttttttttttttctttttttctttttcctgtaatagttttagagtttctgccttaacacatttaggtatattttgtaggaacaaagggaaaaggtatcagggagaggaaatgatttctaaaatgtaaattccaaagacagggaatgttaaaagtgtttgccagtcctgtttcttacagagcacagaactcagatgctcttataaagatacaggataaatcacatcatttcctgctccatcatcagaatattattatatgatttagatcacttttttaaaaaagaacatggmcttagtacagaacaacagcaaaagcctggggaaggagaggagtgcaccatgaggagtcaatggggagcagaagccagtccatttgactgatttggttcgtgtgcaaaataattgctaaataattgcatatatgtgagactccgggtattttcaaaaccagctggcaaaattgtgttattctctaccctctgctggctttcacgggttctctgttctctctccttttcctccattctcctcttaccctaattcctgaccactgtaatccaataatctaaggttttaggatttggatgactaaggttacccatggaattgtttggaaatgtagacctgtaatggagaggggagaaaatgaagaaatagaagctgtacgaaaatagtcaatactgaggccaggtaccgtggctcatgcctgtaatctcagcactatgggatgccgaagtgggcagatcactggaggtcaggagtttgagaccagctgggccaacatggtgaaacctcatctttagtaaaaaatacaaaaattatccaggcttggttgtggatgcctgtaatcccagctactcgggaggctggggcaggagaatcgcttgaacctgggaggcagaggttgcagtgagccgagattgcgccattgcactccagcctgggcaacaagagtgaaactctgtctcaaaagaaaaaaaaaaaaagaaagaaagaaaatagtcgatactgagacctggaaactgagagcgttcatgaatgctgcatccaaagaatattttgtactacgtcttattcatgatacaaatcaagcaaataagcacactctgttgttcacatatgacactatataggtcaacggggtgagagagccacccagaaacagacacacaattttgttatcagatattctggagaggtttctctgaggcagtggcatctgaagaatatacagatgttaaccaaatgaagcaggtgggtttggggaaaaaagtattccaaggagaggggcagggtgtaggacaactaaagagcaagggtgattagaatactttgatgaagtgaaaaaaacactccaatgagtgagcgcgtatgaagaaaagggtggagagcagattattgaggtccatttagatcatgttttagatcctggacagcatccttaaaataataaggagccactaaaagtttgaagaagggcaatgacatgttccaatttgcttttttacaagatcactctgacttctgcctggagtagcatataaagggactaagcacgataccaggtggcacataggagctgaagtrgctcttgtcaaaataaggtgatggggatgggagtggatttgtttcctaggctgctacaacagagaactgtgaatggagtagcttaaaataacagaaatctattctstcccagtttgggatggaggtttcagcaggacatgctctctctaaagactttaggggaaaatctgttcaatgtccttctcttagcttccagtgttgctggcaatccatggagctccttgcttgttggaatatcactccatcatcacggtgttcttcctgtatgtcttcaccttctcttctccgtgtatgtctgcctctgtacctcttctcctcttccaacaaggaccccagtcataatggaatagagccactctaatgacctcattttaactgattacatctgcaaatatcctatttctaaataaggtcatattcataggtattgcagattaagactgcaatatatctttcttggggatatagtttaaccccaaacaggggattattgaaaggaagtgagataagggttagtggaaagaaaccatgtaaaggttttaaaatatatttttggtggtagactcaacaggacttcatgattaagtctgagtttagggatggaagcagagtcgtggttgacttccaggtttcttccagatgatgatgccatttgttgagacacaaaatccaacggatcaagtaagtggtgggttgagcatgggttcatttttttgacatgccaagtttgatctgtctgtgaaatttttatgtggagctgtagatttggtggttaaaaatgcctttggaattcaaatgagagatttgagttggagagataagtgtgggagtcatttctattcaaattatcatcaaagctatgcaagtagataactttcctcaaccagataatgtttagtcagaakagaagaaaccttgacatcaacattaaacattttaaagaacaatgtggactatttcagactaatatgaacaaaaaggaccagactaaccctgccataagaaaaaacaaaccgtcaagaaacagacaggacatttgaaacgatggttttagagacaaaaaacatcaggcagccaaggacagaaaaataagcaaatacattgatcccaacaattgcctgagattacctaagttcaggtaaaagacaatattgtctgctttcaatatttctatttaatttgatattgaaatttgcattcatagtagtaagrcagcaataaataaaaggcatccaaattgtataggaggaaataaactggttttatctgtagacaatatcataaactatataaataactatgaaacatacaaaaaggtataagagctaatgcatgattttagtgaggtttcaaaattcaaatttaatatataacattaaaatcacttgatacaagagcaaagaacaatatgtaattgaattttaaaaaattgtacttataatagcaaaaaatataaaatatttccagataaatctgacaaaatttgtgaaagtttcacacagttaaaaatagaaaacactaaggaaaaattaatgattacctaaataaatgcagaaagatacatttttaatgggttggaagataatattcttaagatgtcagttgtccccaaattcatctatagcttccctgttatcccagcaagctacattgtggaaattgacaagctgaatttaaaattcctatgtaaacgcaaaagaattgttacagctgtaacacttttctaaaagaacaaaactgggaataagtatatttttaagacagttattagcattaagatagacaaatcaataggataaaatagaaagtaaaaaaaaaatagacctatacatatatggacaactgattttggccaaggggcaaaggaaacttgttgggagaatagcaatatcatattttcaacaaatgaygttggaacatctgggtattcattacaaaacggttaatctttgatccatatttaaaatttaactcaagttgaattatagatgttggtgtaaaatctttaactataaaattcatggaagaaaacatatgagactaacagtgtcaattagcgttaagtaaagatgtattagatgcaacagaacaaaacatgatccatgcaagaataaatgtgataaactggacttcataaaaattaaacaatcgcaacaacaaaaaataacaaagaaatgaaaaagagcttctgctctttaaaaatcattattaagaaaattaaaagacaattctccatggtacacaagaaaagatttacaaaggttatatctaatataagatttgtatccagaaagtataaagaaacctcaatgttcaataagagaaaaaaaataaaaatgagcaaaagctttagcagaccactgaaaaaaaatgggtagagaatatgcatatgagaagatgctcaatatcattagtcattaggaaaatgcaaatgaaagcataacaagatagcactgccctcttttttaaaagtctaaaactaaaaatgctgaccatatcaagtgttggtgagaatatggagaaactagaacactcatatcctgtctgtaggaatgcaaaatggttaaattactttgaaaaacaataatgaagcagattccttaaataaagggtgatctatccaactactattagatctattcaattgatctaggtatttacccatggaagtaaaagcatatcttcattataagacttctacacaaattatcacatctttacttacagcagctgaaacctggaaacaactctaatgcccrtcaacagaggaatggatggataaagaaactgtgatgcagtggaatacgactcaacgaagatgagactaaaaataattatactgagtaaaagaatccaaacaaaatagagcaaacactgtgccatcctgtttataccttactccagtaaatgcaaactaatacacaatgaaaaaaattacttatttgagaactggggagaggaaggagagggaaaggggtagataaagaaaagaggagagattaaaaggagcataagaaaacctcagagaataataggtttgtggtaaacattaccgtggtaatgtttttagggtatattcacatgtaaaaacttatccaattatacattttaaatatgtacagtttagtgtgtcagttatgcctctgtaaagttgattttaaaaaaagttcctatttccaagttcacaatttcatttgaactcttaaaaactggccaggagcagtggctcatgcctgtaatcccagcactttgaggagcagaagcaggcagatcacgaggttaggagtttgacaccagcctgaacaacatggtgaaaccctgtctctactaaaaatacaaaaagtagccagacgtggtggtgggcacctgtaattcctgttccaggaggctgaggcaggagaattgcttgtacctgggaggcggaggttgcagtgagccgtgatcgcaccactgcactccagcttgggtgacagagtgagactccatctcaaagaaaaaaaaaaaaaaaaacttacaccaaggtcaaagcagaggagctggcaaaagagactgagaaaaagagcagagtgatagagaataagaaatgagagctcccacggaagctaagggcaggaaccacacagtccttcctcatgctacttagaagttaaaaaaaaaaatgagagttaaaaaaggccattcgtttcagaagtaacattatggactaatgaaaaggaatttagttaaataaggcatgagacaaaagaaagtaggttgactgagaaatgatgaaatagaggtagcaagtaatatggtttggctgtgtccctacccatatctcatcttgaattgtagtttccacaatcccacgtatcatgggagggaccctgggaggtaactgaatcatgggggcaggtctttcctgtgctgttcttgtgatagtgaataagtctcatgagatctaatggttttataagggggaatttttctacacaggctctctctcttgactgctgccatataagtccctttgctcttccttcatcttctgccataattgtaaggccttctcagccatgtggaaatgtgagtcaattaaacctctttcctttgtctcaggtatgtctttattagcagtgtgagaacagactaatacagcaagtataaaaaacattaaatgtttgtcttctaagggaagagaggagagtagagagagagagattgttagctgaagggtaaagtattcttgttattaagatatcagagcctagaacatatttaaatactgatgagaaggatacaagggagagagaaaatttgaatcaatagtttgtttccactaccacagaaaaggatgagatccagaggtttgatagaggaatgagttttcctcattggagagataagagcagatgggtttgaatgctggatcctaagggtgggatattaagggagtctgttttttatggcttttattttctctttgatcttggcagcaaggatgtctgccaagatttaagggtttggacaggaggatcatagttttaatgaataaaaacatatatgaaatagccacttcagagagtggggcagacagtatgtgttttagtttagaccagagtccctgragttataggggtttgaattcaaatcctagctcctccattcacctgtggtactgtgaacaatgacagaaccaagttaagaccccaaatcttctttaaagtgggatgataatggcatgttcaccatagacttcttgggagtaataaatgaaatactttagttcaactattttcacaggtcctgacactgggttttgaataaattgtgcccaggactattgctattataaagcaaaatgaaaaaacacaatggcccaattaatatgtttccaaggagttcaatactaagaagaaaagtattgttggaaatggaaatccacattactagattaacatgtggagaacttgctcaaagaggaggctggtttagatgctgtgataattttagatgtcaaatggactggattatggaaatacccagagaactggtaaagcatcatttttggtgtttctgcgaggatgtttccagaagactttggcatctgcgtcagtggactgagtgaggaagatccctccttaccgtgggcaggtgccgtctcatcagctgatggcccagatggaataagatagaggaaggaatatgtgtttctctccttcttagggctggaacttactcttcattccctgctcttggacaacagaactccactttttggactctaggtattacactagcaccccacttcccatagccgagttcttactccttagatcttggtctgagagttacaccattggcttccagggccacactactccatgccaggatctccagcttrcagatggcttgtctggaggcttttcagtctctataatcacgagccaattctcctaacaaatgctatctatctatctatctatctatctatctatctatctatctatctatgtatctatccatccatccatccatctatgtatctattatctatatctatcctattggttctatctgtctggagaaccctaatacagatgccagcaaaccaaaaccaagtggcaaatgtctaccattgacattcctctccttccttaatgactcttagkaaccaaaaacacatgtaaaattccatgtaatacacaagccagaaaaggtaaaatattgtatctgctagttcacacagctcatttcactaccacaatctaccattattcaaatactgatttagaaaatgacagcctccaaaagactaaaatcatcagtttttacttagaagaaaaagaaatgaaattttaatgacagggaattttaatcttactatttcaatttataagatgtgactggctgaatattgttatgtactaaaatgataaatactatgtgttattaaatattttgtcattgaaaaatgacctattattctgacctattttattttcaggggtacttttagataaaggagtttataaaggcttctgctaaagaagayatcagagaaaatgtcttccaattgatttatcttgctttgtttctgagcatcttgactccaactgtattgcaatgaaaaataatttttttaaatggcagagactctgatttgtcctakgccccttcttctaaattccaagagtctatgtgaactctttctatgagtttcttaaaattcacgaaagtagtctctactggtttaaatggtgtcccctcaaaatttatgtcatttccagaaccccagaatgtgcccttatttggaaatagggtcattgtggatgtacttagttaagatgaggtaatactagagtagagtgggctctacatccaatattgctggtgtctttctaggaagaggagcagagccacagggaatggtgaccatgtgaagacagaggtagagattgactgatgtgcctgtcagccaaggaaggtggcgcattgccggccaccatcaggaagtcggagagaagcctggcacagattctctgtccagtgggaaccagcctgtgtgttaatttcagacttctaccctccagaactatgagacaataaattgcctaaaactgttttaagccactcagtttgcaatagtgtattatgtcagccctaaaaagctaatacaaagccctagagaatttcaataaaggtgtcaggaaatatagatcacagacaataatgataggaccttctagcattcttacacttctgtaatgtttkttgctctttcggtctctcctatwtgcttttattgtgattggcaaaaatcccttgaaaaaaccaagaaacaatacgaacagaaacaaagctatgtacttgttttgggaagcaacctcaaatggaaagatgggggctgtgttctaaaaggtgaggagaaatttatagcgaagataaagagataaagataaatggtcctgtgcaccactgaattctgagaactctgaacaaaacctaagtatatgttagtgcccagtgaatagttgttgaatgaatggatgaatcaacaaataaatgaattgatgagataatcaatctgtgagacaaaaagcaacacaaatgagtagacaagagtgggttagtttggctaaaaattgaagatcacccattttttcagccaagtaggcaggcatctgctayttgccaggcatgggtattggtgtttggcataatgaaatagcaaaacaaagtcctactgtcarggaacatagactcttggaatttagaagaaggggcatgggacaaatcagagtctccgccattaaaawaaaattatttttaattgcaatacagttggagtcaagatgctcagaaataaagcaagataaatcaattggtttaaaatatctttcacactacmcttccatggaaggtgcagagaaggttcyagtctaaatgtaggcaactggagactcccttttcctatattcctttaaaccctatgccccaaaatgtgtaatcaagtctattcttgaacagaaaagaacacagtgccctttctctttggaattttatataagcccctaagaaaagctgctattgtcctagtttgtaaaagtacaaatgggtgagtatgcatctgctctgttcagttggaaaattagtacaggtttcagcactcctcgataccaattgactattgaatgcgtactaagggaagcttctgtacagaccagtaaaccacacaattgcagaaatcctctaattaaagaaacacaccataatcttcctggtgaatctgaagaaaaggttttttagaaaagtacatctgtataaggtacatttgtgtaaaaaacaatcatttttcattgaagtgcagctgtattgttagatgttgttctaagaaaactcagcttaaaatttcttataggctgctttggcttaaaataattgcctaactggatggtcacaaatgaccaagaaaccaaatatatttcatagtattaactatcattacagagtgttaaataatactgcacagtagagatcttttgaaaaatattttaaatgatagattctattttggtttgaggcaaagtcttaaacataacaagttaaataaatttttaatgaaattttacaagtgaaataattaatgttcaagacatagaatcatgccttttggaaatgactctcatgatattctattattttaaaaactatgtgcctatttttaggaattaaattgctctggtagataccygataaatatctatctcacaaatcatgtttttctgtcatatgtaaattttttaaatgttttagtttataggttgtttggctctgtcacccaggctggacwgcagtgctgtgatctcggctcactgaatactctcctttctgggttcaagggatcctccctcctcagcttcccaagaagctgggactacagrcatgcaccaacatatctggctaatttttwaattctttgtagagatggcwtctaggtttccctggttggtcttgaactcctgggctcaagcagtycycctactttggccttccaaagtatgggattacaagcatgagccactatgcctggttagtttctaatttttacattcagttyatttttatgtgactggcatttgtgtaggattatttttataaccaatatgtwttaggtatgtaacccagaagtaaatcactaattaatctgcaccggaggaagtataatttagggagagtagaaactctatctgatagactgcactgmaggtraggtgtcacagccttraarmrcctcagtgactttgggaaaaacaagcaccaagactgaccttccagatccaaggtctggtakcargayggttttsatttccatctgttggaggtctcagcttctgacataaaggcctgctttatacaaaatgagcctgattgaaagatgtaagcsaccaggttagagggagaactacaggaggcagacaggagaaagtaagagaagagtgacgttgttcttccactagcttgtggctactaacaaatttcatcagaaagttgctgaggattcctcagaacaatttacagagataactgtaagctgcagagggctatgaaaacgctcatgggtgctgacaggagcccctggtggstggtgggttgggaatacaggggctctgtagggggtgaaggaactgtgcttgacaccaatcaatgggagcctggagaaactgaggcagggactggaatcgtgctgagactcaaacgttttgagttagagtactcaccaggtactctaactcaatcatatgccttgggtataaggaaattaggaataattggaactgtggctggccccaaatttcatgccctatttatagccattcatcaaatttagaatgaggtaaaggaaggattctttttattatyttttaaaatacccacctyattttttayacccacatcataaatcaccgagagggagaattaggcctgtggacctccctttttgtagtacctcataygtaattttttttttkttttttacasattcatgttttwtggtacaagwgaacgttttataayraaaaggcttttttgttgttgtttttattctctataamaatacmtctrggtgmaaattgttaagaaagctaattattgtatctttacatgactctaaatttggtctatttaaaaagtcaaaayatagrcatttggaaatgactttctcctytcaktactgaagttgagagggagaaggaaaaaaagtgagaaattccagtgcctggatgwtcccaggctaatttctagacaagtgagttttgataagttcaagtttcagatgagaatttcttttttcttctctcattggytttcccacatcgtgarttaaaatgtctctgaaagagtctgaaaaaatatatatattaatgtggagaattayttacataaaattttaataaactaatatgagaatgagaccctccaataaatattgtttagagttattttaatagtcctctcccctatcataacccatttaaaaatgtgggtatatatatatgtgtgtgcattcataaaaatttagtgtgcagttcttagtttttctttatgcaaaacacacaaaataaatgtgaataattgaagccattacacagacatttttcctgctaagttctgtaaatagatattccaataaagacactaccaacatcttactttgtcttaaatataattgagagtatttccatattaaackttttaaataaaaatgattggatttcaaattgccttaaagattcataaygtaatattcttcaccytaaatcacccagattatttctaattgtttctttattttgccttcataaatacagcctttgattaatttagcggaatttatcaatctgagatatttttaccttcccacattacagcatgccatggaatgaaaacttactttgttgctcaaatgtatcaaacacagtttctgtggtcaagttcctctccttttctaaatttgcttagaggatctcataaaacgtaactcctctgacaagrgaaccattttagcaccaacactgcaaaagcttctgtgttcctaagggaaagatcctttcctgaattaaatttaacctctttagtactcccatttagccacctgataaatccacttgagctatcttttgggaagagagaggtatctgggaacaataacacttcctttttgaacagtttaataaagctttgtgagatttcaagatgaaagataatgtgtaatgctgatagtgccctccaaggctctgcattcatggatccaattacgttttttgtcatggtaaaagccacagtggatayattaaatragagtgtggtttaagaatgaaggcccaggagtctggagatctggtttctaaggctgacttcacttctgctttcttatctcactaggggtatgcagcttawcatctttacctcagtgtctccttccataaagtgyccagcaaatatctgagaaattcttttaaaatgacagtgcaaaytgccatttagaatcamcttggaatgtctagaaaaaaatgaggtgaatgttcgttcagaacgggaaatacaatcttstgcttaatttcagatttatcatcaagtttgtcttttactttttaaaagtcatgagatttccagaagaggaatgacattttcaaagccttaaggacacttgtgaaaacactccttcaactattctttatttctcaccaaaattttgactctggcttttctccaacttcctctcttccccaattcccaattccaacttgaaaagagtaattgcaatcttaactttttccattctggagtattttcttgcagccgatttgtttcatataattgtaaatttatgcatgtcagattttgttttagatgcacgtttgctggctttagtcagtcaatccccaaacccttaaactgattaatttcaccgtgaaataattgattacgaatttgtagcaytatctgactttattttaaaatgcaagttgatagaacattgtcatttattgattaatctattgccctttgccttgagataattttgaagaagcagaatagtgccattagtaagacaatatctatgtattacaaatgatcatgttcttaaaatacacaygcacacacacacgcgcatgcacacactcacactttctagtaataagcagtgttttgagtaaaatcttttgaaagatgtttagcaaatcgaaacaatttctgtcttcctatgtgatgcctgcaattatatggtttagatatttattgaaggacttgggaaacctcatagtcccattggcattattctcaacatatcaaagattcattcagtataaataaataatttcattacttataataataaaagttatcatggaaaattttataacctagtaaataggatgtcatagaaatattcaacacggataaataaaatatatacatagtttaaattagaacacctgttatagaatggtacagtctaactctctggccaggtaagcttctagcatgaaacttcacacaatcatacctacaatatrttcttgcctaattccttgttccaaaggaaagtttgataaggaagttgaataatttagcttccttttagagatggtagagcttatttaagtagctttcctktagtacaaaaagattaggcagctctgattggaactctagattgaaaatgagtagaaataacctcttatagaacacgtctaaatttaactttgcttcacaccrataaactatagcctctactactttatagacagattatagctcatcagtaggactaaaaatcactgtggaattactctgcaatagtcctgttgctatgtctataaatataatttcagtgagtgacttttccattttctagctgcttggctatactttttttgcgtggcaaactaaagggctttaggaatatggtaaatgacaaatttaaatagcctcagataaaacatgaaagtcaacattaaattatttggttaaacattattttcagaacaattttaaaaaataatattttgcaactgattttaacttaatgtttatactattctaaaaaggtaaaaaaaatgcaatgttgyttattctcgttaagcctaacatgaaaataaaagcattatttaggggaaaaagtcccatttaattatgtgaacacataattaaataattatcataagaggcaaaaaaagatagatagcatcagatattgtagcttggtagagcttcagtactagggggtcaaacagtkgaaaataatctgggaaacagttttaagtgttttatatttaaaacacctacacacacaaacacacacacacacacacacacactctcacgtaggcagtgtgaaatttacattgttcctttcccatgttattgttgtgtatgggcaggcttatttttcacatatttccctctcaatagccttggggttctaaagagagacacaacattatcacccaagatgcttgacaaagatgggtattttgagggtgatccagatttactgatgatatgaggcctggaaatctgaaaatttaacaaactttcctagtaatttttataaaaaacaaaattcaagaaaaactactgcatgaaaaaatgtgaagaagccagtggatacttttaaaaaagtgttaaaatggttcctatgtaatagacaaataatctctgagctagataaaagttcaacatgaagtataatctaatattaaaaagcccagagaagttgctttcgtaagttccaasattagcatttagctttctcctggttaaaagtttaaaatgaagaagatacatactctgcatagggctgaggaaggtaagagacccaaggacataatgatctctgtaaatgcctctgtgccatttccaaatagccgtcctcatgccttctcttccatcyttctttccttgttaccgtctctcttccttmttctgtctcctttgctgcaacagtatttaagtggatatataatacatattaactctatcacatcttttaacatacatgttggtttaatgactgtggagcgattgtaggaattgtccattttacttaatttttcagaggtttttggttaagacaaaattccctcagagactcaaatgtcatctgttgattgaaatatacatctgtgttttgagattaagcccaaacgaagggtggcttctctctctggatcggactatactttgagtcatttagttacagtaaaacaaaaatatcaaaatggcacgaaaaaattaactgtggtgcctaattctttgttcctcatgaaatggattgcctataccatacttaaataacatgtgcatagcctttccaaagctccaaacctcacgatgaaatagtcctctcgtcccttccctgtgtgastgttgggaagattccttttccctgtcaaggggcctttcctccggtgttgaccacaaggtagttttttgaggggatcttaagttgtattagtattttatgagttcttagatagggttaaataattcctcttactttggcgtggaaagagaatggagtgtgatagtgaatgtgggaaaaagttgtgaaagactgtgaaatgagctgtaaagattactaaatcacctgactagcagagtcttccaagatttctctgcctttcatcatctttgagctattttgcaactttgtaaaattttaaaaatatgatataaatgcaattgactttcttccagaaaaatgcaaagagagtgtccagtgaaaatgctaaggattattgctctgtgaatcgaccagttttacctgtagatgattttaaatttgcctttgaattggttgtaacatcttattgtttctcttattaatcaagtaaaatctttgattcatgttcatgatacatctgtatgagcttaccatgtctttaaatgccttatcatgttaacataacctactttctagacaaatagsactccctttcttattttcaagtaagtagcaaacacttatttgaaattctgagcccatcaatttattttttatatgaaaggatgaacatttcctagaagccctcttggtatcatctaggtaaacttcatatcaaatctgtgctaatatgttatttgtcctggaactggttcttagtccaaattttataccatttattcgactcttatatccttcaccttgatcaatataaagtgcatttgccacacattcggtttgaccaatattattctctgtatagtggctttaactcaattatcaaactgtattttaaaaattgaatggccaggtgtggtggctcacatcttctataatcccagcactttgggaggccaaggggggcggatcacctgaggtcaggagttggagaccagcctggccaacatggtgaaaccctgtctctactaagaatacaaaaaaattggccgggcacggtggctcatgcctgtaatcccagcattttgggaggccgaggcgggcggatcacaaggtcaggagatcaagaccatcatggctaacacgatgaaaccccatctgtactaaaaacaaaaaattagccaggcttggtggtgggcgcctgtagtcccagctactcgggaggttgaggcaggagaatggcatgaacccgggaggcggagcttgcagtgagctgagatcgtgtcactgcactcgagcctgggccacagagcgtgccatcaaaaaagaaaaaagaaaaaagaaaagaaaacaaattagctagttgtggtggtgtgtgcctgtagtctcagctgcttgggaggctgaggcaggagaattgcttgaacccaggacgcagaggttgcagtgagcccagatggcaccactgcactccagcctgggcaacggagcaagactctgtctcaaaataatttaaaataaacaaataaataaaaatagaatattttggttgggtgtacatgggtgagctgctttattttatgtatgtagaatttctaaaataattgtgcttttaccgtctagcttctataatttataaatatgtaataaatagtagataatgttaatgagtgtgttgtttggcattttgttagttggcttaaaaatgagaatgataaaaaaggcatggtatcagggcattttaaaattattagccatgggggtaaaaaagaaaaaggaaagtgagacaagttgccagcatggctacacagagaaattccagtttccccaaaactggaaaagaatagcattttatatgaggacagtgtgcttaatacataacaaagatagctgctatatattagaaattatgtttgttattccttaagcagttatttttaatcttgatagtttattctggttagatatataacaagaatataactctagtctcttcttgcaaaaaaaaaaaaaaattccaatgagcaagatgattaatccagtaaagaaacatgtccagcctggggacaaaaaaaaagtagatcaaattttggttaggaagattaaccaagtaaaaatccattagctggaatttattgtaaaagccaataagaaatcatccaagaaataaaaaactaaaaatagccctcaatatggaataaaaaaagacatagagtgattctctttgcattcaatagagactgagaaaacacaactgtcagaatattaaatattgctttggaaagtttggaaatatgatgaaagtaaattagacaattgctagaaaaatatccttcagttggttccccacacatcacaaaattcagcttgataccattttctttttcttgacaaatttagggcttttattagtgctatgacagaaagaaggaatgctaccaaaaagaccatttgaatttactttaattatttcagagtagggaaacgataattggaaagtagtttataaccttgagtttgtaaaatctgtaaactctcacaacgatgtgaaggcagagaaagtatcaaactcagtcccctataataagctcattacttcataaaatatatatccccttcatctatgtgtcagaaatgtttaaaattttcaccactggtacattatttttgggccttacatttttgtggatttggtgaatacctgaaagaaataaaataggattggataatgtgaatttcttttacactcattgtcattattagaaaataaagcccaaataaaatatgacagagcagaattagttttaatacaggaaaaatttgcaagttgaagaggagaaaatgcagccaggaactaacggtacacacctaggtggttaagacagtgtggatggtgataagagaacataaggaaaattctgccctccagctactttgaatttagtgttctgcctagtatgaatattattgaaccctatggtatggtacttaactatctaatgagatgataactctctcctacctgtagaaaatgtagatgccttgtctacttctgcttatatacatgctgaaacatactgatgtctgctgtcttcttaattttacactaatttttaaagtaaagattgatttgataaaaaatatgcacttggaaaaattattctgctattcccacatttcatgttcatgtctatttacagctaacaagactagcacgcaaatagatatatgctccaagatctcgcttcttttcatgtctggcttctccctgtttacccacaattattttcataatattttactgtgattccacaaaccagagacaaatctctgaagggaatagtgttccaaggcatggccatcattagaagacaataagcttgttttccttccaacattcttagctttgttgaaggctaagtggaagaaattaacatactgcatgcctttcaatgaaaattgtttctaattattttgcttctcaaattattccacmaggcattgattagactttttaaattcatttcatatctgtcactctcagctaacatttgtaattttttaattgttgttaaagagaatctattaattgaaatataattatcctctttaataaaagtaaataaaattacttgggtagccaacatattcaagtaatcatcaatcttggtcagaaattaaaagtaagatgagcatctaaacttggcactcaaagactgaccatctgcacctttgaggcaaaataaaattcagtttaggaaaaccttatgaaaatcaatgttttaattatgctatcaagggctgtggtaggcagaaacttctttgctccaccccccaaaaatgtccagttcttaatcctgaaaacctgtggaatcttgtgtaacaaagggacttcatagatgtaattaatgttaacgaccgggaggtggagagtgacctcggttatcctggtgggtccaaggtagtcacaggcatctttataatcagtgaaggtctccctgctgtgcttagagagggggatgctggaagaagagtggtcagagaagcaacattgctgactcyaaagacagagggcaggccacgagccaaggcatgcaggaggcctccagaagctggggcaggcaagagaatggactcagccctggagcctccagaaggcatgcagccctgcccattccttgcttttagccaggtaagatgtctgtcagcctgatgagaactatgaaataatgaatgtgcttgtttttttcaccactaaatttgtgcttatttgttatagcagtgatagaaaactaagacaaggctatatcttggcatgtcagattttaagttatctgctatagtttagaaaagcccanagaaggagctgcaatttgtctctttgaaaaaaaaaaaaaaaaaaaggatcaccttctaggggattaaacattaatgggctgggtgttgtggctgacacctgtaatcctagcacttggggaggccgaggcgctgctgcactccagcctgggcaacatagtgagaccctgtctccagaaaaaaaaaaaaaaaagaaaaagaattaaacgttgacagattattaagtgaggcactgtgtgagacctagcttgggtttgcgcctatagatatttaaaagttgatccaggttttcacttgaaagcagaactactgccttaaattcccacttcacaaaaataaatcatggattgagggaaaaatttacttgtttgctttataaaaagagatatcgatctcttcataagttatatatgttttacaaggttgcactgtttgaactgtaagtgtgaatggttgctaacactccagaaaccaagaggtacattttaactggaaaaattttcttcctgtatcttacaaattaattgaagtttgtctacgcttgaaaatatgtcaaaagtattatgtagctttaccacagttttatctaacttctagaagaatttaaattcatataaagataaagagtaacataccaatagagtttagagagttttcagatttgctcagaagaatgctcytttgaaaacctatgaagtagattttacccaatgtatatctggatctaaaaattaaagaaaatatcagtcgtgttcagattcctttataccctgcagaagaragaaagaataagcaacatcartggagcatataacatgtatggtttagcactttcatatttttaatcttaactattcagccaaataygtcttatttttttatttttatagatgaagatattgaggtttgcattttttttttataaattgctcagtcatacagttggtaaatagctgacagragagttcactccaggtcttactggctctcaaacctttgctttttaaaaatctccaaactagcgcctctcccttttaactgcaaaataagcacaaagttatcccagttctacacagtgctaaacaaattcctgtgagcaaacaattagcacaggcagatggagtgagggggaggtggtttataacaatggaaagctgtctgcctgctgtggattaaagattcaaactctttgatcctcctcccagggataggtgagggcctatgtctcctcctcattaacatgagtgatccttggctaggttctcctttgactgacagaatatgggagaaagtaaggctgaaccatatactgggctcaggcttccaaccctgacatgttccacttcctgtctccaggaacattcaccctgggagctctgtgctgccatgcaaatgtcacattgcactgaggccrccatgctgtaaaaaaccccaagctacctacctgaaaagctggagakaatcagcacccatcagcttttccagcattttgggtcctcccagctaaatcatcrgcattgtgaagcagagatgagacctcctgccatgccctttccaaatcctggaccaacagaatcatcatatacactagtaagcttttactttaagccactaatttggggtgtagctcttttgcagcaaaagatcatcagaacactgccatgcaggagctgataaacttgctcactsttatgtatgtatccaatgactactcacacacacattacttgcttcactctactttctggctttccattcagcaaattttaagaaaygaaaatgttattcgtgggaaattaactcaagatcaatattgttgtagttaatctctttgtaaatggtaaaatattaaattattgtgagtcatttttatttaaagaagtttggttctttaaatgaaagaagtttgggtcttttgyggatactctgcatatagacattctagacatgaaagaawgttgaagacaaagaatgttgaagaaatatagacatgaaagactgttgaagtttggttttttgtggatactctgcatatagacattctagactggagtgatacatcttgttcaggtttctatgtttttaaaatgataacttgacacgcctaccaatgccaatttttaggatatatatytgtatatctgtgtgaactaaggaaaattcaggaatgattaaacytacatattttgccaggagagactggataatgtaagtctttatatttttcacaacttcaagtttatagcatccaaatgagcaattgctgacatacctagkggatttctctgcaggttcaagtctgatctggcctgagggcaacactcttactgagtgtgttcctaggcactccttggcagttggctccaggccacaataaagagccctgatgattctctgagcaggcccaacttccattcacattcrtgggaatatgaggatgacttgtgatcttcaggacttagatagactctttcagttggtgtagggtaagctcagctcatctctagagacttcccacagtggagctcatgcatgamtctgtgcaggtggcacaggacagccagagacaggcacctaaggagtgcactaccagcaggtggastctccactgagggaggtagacaagggagaaagccaggtgtccacatggagcaggccttactcagggrgactgagattttgctctacacatcataaaacgtggaggtcattaatggaatttttcacaggacatgactgccatagccatgatagggtccctggctaatctttcaattrtgatagcatcataagataattttgaatatgaggagagaagaataactctagaactgcaatatccaatatggtaacccctagcaacctaaggctacttaaactaattaaaattaaaactttagttcctcagtgccactagccatatttcaagtactcaataaccacacacacttggctaccatgttggacagcactgacatagaccatttccattactgcagaaagtcctcctatttgacagtccacctctggaaccaatccggagtctttagggacctaaaagactgaggtgctaaatctcagagcagtactctgcttaatgcttagttaaaagacttgctaatctatatagttgatctagagaactttaaaggcagctagttcgtagcaactatgttgctggaccttgaaactgtatgtcaggaacttggtgttctagtggtgacttctcttttatctaccatgttcacacttttcctaccactcatttatccattcagaaagtatttcagaagtccctatgatttaccaggtgctattkcagacactgaggcactgtggggaacaaaacaaacaaagtctcctttctcagggatctcacattccatgtggtgatgcagactgtaaaaattcacacacagaagatactttcatacagtaggaagttttatgaagaatatttcaaaaggggtgtggggtgggagaggttgatgttcaggtgtttgcttgagaatgaactgttcatacaaagaatcaataattcatttgttccacaaatatttattgagtacctgttattagcaggctactttattaggttgccagagcagggttttcttagcacaattaaaacacaataacatttgttagaaattcaaagacccatgtccactcttgcataatgaatcagagtctcgaggttatggtccagagactggtgtatttaaaaatcactgaagtaattttaaggtatagccagaatagagaggacaccggcattcttcctgaaactcaacacactagacaatgagaaatcattaaaatgaagtaaatattttgattgagattgttttggcttcaaaattaataatagcttggagaggaaagaaggtaaattataaaagacaattaagaatctcttaaatgtatttagataatagttacagagggacaaaaatgagtaggatctgtgataacagaaagaataaaaataaacaaaaggacttaaaaaagtaagaataagaaagaagtcaacagtaacccagaaattttcaacctcatgtctaagagaatgatgatgctatttagcaatatatccaaaccaaaaatactacgagaagtaggttgtgttcacttgtgatgttgtaaatttataattactttttctttattttggatgcatgcttttcctttttctgaagttctgagacatacaaaaacaataaagaaaaacatgattttatgccagaaaataagataggaacaattcctcatgctcaatataattttagcctcccacataatccaaaatatatgtgcagcaaattgtgggagtttcgaaattagatccaacttcttattacagttaaagataaaaagaaaacaaggctttgtcttttttaggatcttttttggaacttgcagtataaaaatactctttcaaaaaacataactcaacatcaaagtccaataaaacagtaaactggactaaatatattcgtatattagcttgacctaagtctgggaattgagccagacttttcaaattatactatcattatttacagaaaaaggaaatgttaactaacattattaaataaaagcacatatacacatgcataacaggaaacaaaatgaatgttaatgttaacaaatgttgaagatgtgtgtgtgtgtgtgtgtgtatgtgtgtgtatacaaagcagataagatattctcttgagcatgattggattggaaatagtagctatgccaggggaaattttatgcaatccccttggctgtgggctacacatttattgtgttatacaaatatgccaaaaaaaatgccatttacacagttgcctaaaacaaaattgaaattatacattagtgtttaaagtttttttttttctttcgcctccttttcttaatgaatggcagataatgaaatttaggagtttgcaaaaacaaacgtagtttaaattgtaccttagttgtctatgaaatacaaatacattttatatatttatggaaacatttgtgtgtgttcagaaagtccatattttgcattcaagattgaccctgttttaagtcatatttcatttgctacactcaaattgactaaaggcagatactttggcattcactttttgattcattattaaggcattattttgattgattctgcttaaggtagttttcctgatcagagtagacgtttaggccacctatctagacaaatatcccactwtcctatctgaaatatttgatctctccttacccattctagggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggtatttattcttgaaagacagtgtaaagtgtctgaaattgcagaagcaaagtggttgctgtagaaatacataccatgacgtgcttcaactcgtttccttaaaggttaaagaaagaaaaatgtgcatcttgaagaaaattccaaaccctcattgtgaggagtaatccaatatttcaatttagaaattcagagggttttaaataagaagcaattattctaggcaaaaagcaaatataaatgccagcagtcaaaaaaccagtgaaaagatatgattaaaactgagatgtaaaaaatagatatttatctgaagttcttgacttttaaagtccacaggcattttcccttaagaaaagaataaaaacattaaatgttaaagaaaaacataagaaatattataaaaaagataattattcagaaaatattagtattttgttaccaacaccaaagacaaacagagtatttttcaatgactggaagccagtttaagtgaggaaaaaaaaaaacacgttattattactgctattatccattatttttatttttacttttggcagtgttatttgctaatcagctaacgcatggtagtggacttgatcttttatgtattataaaggttgtatcttctcattttaagggaatattttaactacattgtccaattgtacactataaatgcagcaagaccaggtcaagtgaaacttcagtgggcgagtctctttcttttcttgtgtgtagggctctccctcccacctgctaccttgactttttagattccctgttcccctggtctgtgcttgtataatatacaagctgtccttgacatagcacgttcctcttttttccttcattatttttaaatggttataatatactcttaaaaacaaatttgaatattactaatagattctaatattatcttactctctgaaattaagtagtgatgtatattgtgttaaacgcttgtctatgctgatgcaacatatgggcaggtctctctctgggcctatatgtatttgtttcatatcgttgtacacagattcattcatttctttaaatgggtatataatatttcagtgtataaattaatcactcgtaagtggctagtaatttaatttgttgctacttcctcccaagatgaacagtgctttagtgagcatctagccatttctgtatctgtctacttattgatttatgcatatattcaccaccttcttcttccacaaatagactacacatcctcttcatgagagtctacacaaaaatgttacaaataacatttttaacgcaatagttcccttaagctcacacttgtaatgtttctgcccagacttaagccagccaaatgtgtggaaataaattccatttgtgtattaaatatcaaagatagggaacattcataacaaatgtaaacatagccaaggattcattgaaacatttccacataccatctctccaaatctggttttaaagagattgtaacataatttcaggaataaagaccttctggaattgagatttatggaaaagagattatagctccacaagattctagggatgcaaaaggtctggaggagcctccaggcacaggcactttgtttccatgctgaagattcaatgtgggttctgaaaatgctgctttagcaagcacacatttgttccactggtgttggattttctattgattaatagttaccatttttttcttctcttaggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaacttaaaatgtgtttgtaacaagagtcagcacttataatgaaaaatataattaattaagagrttayaaaacttataagcagagtttactctgcttacagaagggcaaacatttgttatttgatacaacatattaagtatttatcccatgcaatcactgtcctaggctttgagtttatagtgatgatcaaaacgatttacaggtttcaagaaccctgctcacatacagcttacaatcctatgtgggaaaatgataatagtgaaataattacattaattaatatatacttgattcaaatgtaaataattattctgaaggaaagacacctacatcaagagagctggcttaaattcggggatcaaggaagcctttccaaataattgttgatgggattgaaagacaattgtgggatgagatgaccacctgggcttggtatgggggagatacaactgtcagtgggaaagccctggagatggggaagaagaacttcttcaatggagagaagttcctgagtgagkagaaggcaggtgaccacagtgtgaagtgatgctatagaagccaaccacgtggctatgcaagcagaaggaatttatccaaaaagaaagggggaggcattagagggatttagtgtggagagtggtggtgacaagatcagatttgcaacttgcaactctctctcaggttgcagcatgggggatgatgggatgagcccagagtggactgacgcatttccagtagtccaggagagtggcatgtggcatgaactgtgtgaggaagggggagctggggggaagaagtggggtaacaacaccctatttgttgttttgcttcttacactttgaaaaatatttcaaagcaggaatgctattccagacatttaacacctggaacaggaataagtaccaaccaaatatcgtgggagactgacgaatcagaatgaacatcagctctgcatggcagtatggttttaaaacactttcatgtctatgtaaacaaagtaaaaatgttaaaagattattttacgcctttggttatcagatagtcagacttttagtagtttatattttattgcagtctgatgaggtctgcttttaatagtagttttctcttcttcccccaaccccattacattaaaatggcaaatgatacttttccttgttagtaagcaaggccaagttaggattatcagaaagtcaatacctaaacacaaagaatagtgcagccaaacccggaaaatattgtctgttttgccaagaggaagcatctcactgagtatctggaaagctcattgtttctcaattatggttattttattagttgccataactcagctatagtcataatgtaactgaccagcaccgatgatgaaatcaataaccactacaacagagtaaatgctgtttggggtgcaagaaacatcatttttatctaagtgaaagtacatctcatttaaatgtatttcaagttgacattttgtatatattgttaataaacttcaattttactaaaatctctgcaatatctaatcaatatactgaatgatatgctctccccttttgtgctcaaataggatctgtttatattttagttaagaaatgctatgccattttattatattagaaaaatatttactggtaggaatttggtttaaactctccctgttattcagctgggaagtatattacaagtaagtctttaaagactacaattggagaccgggcacggtggctcatgcctgtaatcccagcactttgggaggccaaagtgggtggatcaggagttcgataccagcctggccaacatggtgaaaaccccgtctctactgaaaatacaaaaattagccaggtgaggttgcaggcgcctgtaatcccagctactcaggaggctgaggcaggagaatcccttgaacctgggaggcagagtttgcagtgagctgagattgcaccattgcactccagcctggagaacaagagcgagatttcgtctcaanaataaaaaaaaaaaaaaangaaaaaaaaagactaaaattggagagtttaacgtatcaaatttaggagataaatggtaaataatatgtttgtatatgaaaatattttaatacaatatttgaaatgaagaaactgagatcacacaactttttgagcgttgagtttatacatttattttctttctttctttctctttctttctttctttttttttttttttgagatggagtctcactctgtcacccaggctggagtgcagtggcacagtctcagctcactgcaacctctgtctcctaggttcaagtgattctcctgcctcagcctcccgagtagctgggactacaggtgtgtgccaccacgcctggctagcntttttgtatttttttagtagagatagggtttcnactgtgttagccaggatggtcttgatctcctgacctcgtgatctgcccatctcggcctcccaaagtgctgggacgtgagccactgcgcccagcctattttctttcttttacctatatcatttcatttttttattgatacggaatattttacatatttatggagtacatgtgatattttgttacatgcatagaaggtgtaattatcatcacggttttggggatatatatccccttcagtatttagcatttttatgttttaagaacatttcacattctctcttctcgctactttgaaatatacaatacattgttgttaactatagtcactctattctgccattgaacattagaacttaaaatactttccagccaggtgtggtggctcacacctgtaatcccagcactttgggaggccgaggtgggcgggtcacctgaggtcaggcgttcaaaaccagcctggccaacatggtgaaatgtttgtatttgtaaaactacaaaaatcagctgggcgtggtggtgggcacctgtaatcctaactactcaggaggctgaggcaggagaattgcttgaacctgggaggtggatgttgtagtgagcccagattgggtcattgcactccagcctgggtgacaagagcaaaagtctgtctcanagaaaaaaaaaaaaaaaaagaacttatagcttccaactaactctatgtttgcacccattgatcatcttttcttcattccccactctcagccatacacacttcccagcctctggcatctatcattctactgtctacctacatgagatcaacatttttaattcccatgtatgagtgataacatgtggtgtttgtctttctgtgtctggcttatttcacttaacatagtgacctccagttccatttatgttgctgcaaatgacataatttcaatgntttttgtgcacaattagtattccattttgcttatctatttgttaattgatggagatataggttgatgctatatctttgcaatggtgaatagtgctacagtaaatatgccagtgctggtctccctttggaacaccgatttattttcctttggataaatacctggtagtcgaatttctggatcatatggtacttctatttttaattttgctcagaaatctccatagtatttgttcataatggctgtactaatttacatttccaccaacagtgtataaaagctcctttttccctgtaccctcaccagtatctgtcatttttttgttttttttagtaatagccattctactggggtaaggtgatatcacatagtggttttgattcacaattccctgatagttagtgatgttgagcatcttttttatatacttggtggttatgccatttgtatgcctttttttgagaaatgtctactcatgtcctctcatgtcctttgcctactttttaataggattatttgtgagatttgtgaggttgttttttgtttgtttgtttgtttgtttgttttcttacagttgagctatttgagtcccttgtattttctggatattagtcacctgtcagatgaatagcttgcaaatattttctcccattcaacaggttgtttggagattctctttaaaatagctgcaacaaacaaacaaacaaacaaacccggccaagcacggtggctcatgcctgtaatcccagtacttagggaggctgaggcgggcggatcacgacgtcgggagatagagaccatcctagctaacacagtgaaaccccgtatctactaaaaatgcaaaaatattagcctggcgtggtggcgggtgcctgtagtcccagctactcgggaagctgaggcaggagaatggcgtgaacccgggaggcggagcttgcagtgagccgagattgtgccactgcactgcagcctgggtgacagagcgagactccatccaaaaaaaaaaaaaaaaaaaaaccctaggaataaatgtaactaaggaggtaaaatatacctacaagttgcactaaaacacactgacaaaagaaattgaagagggtgcaaacaaatggaaagatatcctatgctcatggatgaagagacttaatatgattaaaatgatcgtatcatccgaagcaatccacacattcaatgtaatccctatcgaaataacattattttttcacagaaaaaaatttaaaaatcctgaagtttgtatagaaccaaaaaagagcgcaaatagccaaaactatactgagcaaaaaggacaaagctttaggcatcacactacctaacttcaaaatacaaggctatagtaacaaaaatagcatggtgttggtataaaaagacacatagagaccaatggaacaaaacagagaatctagaaataaaaccccatatttacagctagctgatttttgacaaaaatgccaagaacatacattggggaaaggatatcctctttaaaaaatgtttgcaggaaaattggatttccatatgcagaaaaatgaaactggacccctacctctcaccatacacacaattcaactcaacatggactaaagacttaaacgtaagacctgaagctataaaaccactagaaaaaaacagggaagacacttcaggactttgttctaggcaaacattttatgggggagacctcaaaagcacagaggacaaaaacaaaaataaataaatggggctgtattaaactacaaagctgcagagcaaaggaaagtattttcttaatccttactggttcttaaaaagttttggatgttgaccaacacatctattatgataattaaatgatttggacatgtcaagcttgtcaggatatgcgcaggttgccccctttaggaagagcacagtgactctttctaattctatttttctatttcttaaacatagctgactataaaattgcaaagaaatttgtgtatgagctagggaagatgttgggttgggttgagattcaaggaaggagttggactttaaaatggtggaatcaccagtagaggacaacaccgtgtaccaaaaacgttcacaggacaagccaggttgtacaccatgatatatgagttgtgatgctgatgaaggacatagtaagcttccaataatgggtcaaaaaaaaaaaaaagaaaaaaagaaaagcattaatattaggcaatgtattttggtgcctataatttatattcttatcaatacggatagctccatattgatctgtttatatatatctatttgtttatatcatttgattaaaatatggcattgaccattggaaaggtacatctcaaattatcctggttaaatgtgaaagtatgaagaggctgtgattataagcatttaagtttcaatcaagtagcaagtgctgtcaagatggtatatccaatcagatattgtgagggacatgtgattgctatagattattctgctgtcttaagagataggctgtggatattcarattgtgattttggagtttaagagggcaaagtaaattgcctgctgaactcacagtcatgtttgagagagactgacaggaaaaggtaaaaatgaatcatcatctacaactggctggattggacctgacggaataagatccagcaggaaaggtgtgtgactaccattcctggaactgggttttgctgaatcattggacagttttgctgaatcattgagcatacaagttttgagggatacatgtgcatttagaaagtaacgaataagaatattcataattatctgctacttttcatagcccatgtattaacaccaaagcaattttagatgagctatcaataaaaatattaaaaaagaaatcacagtctatttatttaacacacattggttatagtcaacaaggtaatgtgttgtgctgcaataatacaagtaaacatccgtctaagaatccattgtttagtaggtattactgtacgaatttttaacaaagctgctttaaacactataccaacagttttaaatacaaaagcccagtggtcaagctctaatataaatgaataaatgtggccttctggaagaccctagagagacaacaggacacagagtggagcacaggaaagaaagaagtccacttcctgcataaatggcggcggcaactctgtttcacctgacagacgcctcctcgaaatgcagtcccatttaaaacattttttgattgttttagataaaacttataacattgttgaagaagcaactaattctagatatttttataattttaagctgccagaaaaagtaagtccacaattggaaatggcccaaggcccccaggatgtaccttacctatgccaatattgagaagattattccagtgcaaaaggtccatgtaactttcattaacactatggtttgttggaaacacactaaaccactgttccataattcctttttttttccagttactcaaagcaaaaataccagaattttatgtttacaaatgtgagtttttaatagaaacatgcacagtgtatactttatatattgccggaattgacttatcgaatgataatttaacaagattgttcatttgaagtttatgcccacttttataaataaaagaatcattttggttgtcttcctctctttctctttatttttcctttcttatttcagtctacaactactcccccttcttctggcccatgtggagatatcccatttcccaacctgctccctgttcagttacaaggagggagggaagacatctggcagaggaagattcccagggaactatgaaaggagatagtgactactgcagagcttgttacaataacagactattaaggctggtgcagtggctcacgcctataatcccagcacttcaggaggccgaggagtgtggatcacctgaggtcaggagttcgagaccagcctggtcaacatggtgaaaccccgtctctactaaaaatacaaaaattagccgggtgtggtggtgagcatctgtaatcccagctacttggaggactgaggcaggagaatcacttgaattcaggaggcacaggttgcagtgagccaagattgtgccactgcactccagcctgggcgacaagagggaaactccgtctcaaaaaaaaaaaaaaaaaaaaccacaaaaaacaaacaacaacaacaacaaaacagactattagcactttctcatatcccttgtttgcttaagaatagtatttgaataatataacggcctatattttatctacctactctctgacttcctctggtttggaggggggtgaatcatcagaggtgttgttgcacagtatgtgtgtgggtaaatagggtcccttttctctactcatcttttctatgcaaaataaagccattggttataatgaagaggaaatcagaggggaagaggtctattttgaatttttgtaaccgaaaaagctcatgattttatgtgaatattccattggctgcttagcttgcctacttacttgaatttggagtttattcccaacactgcagcttacatgcaccaaggtttgggaacattctgtaaaatttccttgaggacaaatatccgctttgttgtattctttgttatttatccattttgccaaattatctgcaagtagaaatatcgaaataagaagctctttagcaatttactttggatattggttttcttttgaaggacagttattaaaatagcttgtaggattactcattttcrtttttcttctttttaaatataaagcaatgtcatcacttttttccctgtattatatttctcctcaataattgatatgctacattaaaggaacacaaaatggtcttaattatgcaataatgatcaaggcaaagagtgtttcctgggaactaatggttgcctgagaggaggtgatggcttgaggtccagctggttattaagccgcaggaaatgctgcaggccaagatttgtattatttctctgagatgaaaatgaacccaaaaaaaggcaaaatgggtttttctccactaatgggtaaaatgaactcattttggatgcagaagacctttatgtagaaggaatgtattccataaaagcaaaatcaaaatgttcagtggtctctgctttttgtttaaaatatagtatagcacaaataatagtccattattgattttaaatcttgatgcaactaaaaatatcatgcaacacttgagtttttgtctagttctagaacttccatagaatattatgtccaacaattgttttgatagcttttgtaagctaagaatatattttgtatgcatttaacattgaaaatggttacttctgaaaatattcagaaaacagctatctcataacaaaagaatacaggcattattttcttttttttctggagttcattcaaaaaatattggggaaaggtgtctcattaaaagatgcgttgagatttgtggtctctctgcatgattagagatgaatcacttaaccttcttaaagaaactgcctaatcaatttgtaaagtagttagtatagctgcccccatctctgatttgtagtaggattatgcaaagcagagtattttgtagatattaatattactaatataaaaatgtagttattactatatttactttaccatcttaaccaagtgaaacaatatattttatcatattttgccatttttgccacccctgtgacatggggtatgtcacagggcatagtagacaactgaaagagctcctaatagtcaaaactggaaaagtttcagaacaaaattaaccagtagtattagattataacccaaaatacaaaataaatgtttctgaattcattttgatttaaatgaatgacagaatacataagtcaatgggggagagtttattcttgcatgcagaagaatccagataatttatgtggatgccctgccttcaaagaggcagagcctaactctcattcctggacagcacagagtgacttccttccaaagagtacaggaccgaaaggggtgaccaaaagattgaagaaagatcaagcagttatcatgagtaaagcaaaccttgacaagtttatcgcaatgtttagaattttgttatattcaatcgaggactttacaaaattgtgttaaactttatgatggatatgggtgtccttcttaatagagaaagttcaaaagccgggtgctttggaggaaacattatcttttgtctgccactataaatgtgactaaaatagtacgtaataagcatatggccacaaacttaaatgcattatgttgccaagaaaatatgttggcaggtgtgtagcaggccttgcagaagatttgtaggaaaaatcataaaacaaagtacatagtgtgagatgtttgctatacatgaggattttttaaaaagcagatctagtagaatatgatttacttagagaagatttgtatctcttgtgttcagctgaattatagcatctaacacagcctgtgccacacagtaggaactcactcaatttttgttgaaattattcaacgaatattttattttaggcttttgcaagatatgactttggtaataaatgtagcacacttaattcattgaacactaaaggaaacaaatgctaaagaaactagtttccaggcacaaatgacttgcttaatagcacaaggcacatggtggggaggggaggtaactacaagatgccaccctgaaggagtcactgtttcatctggagcactagagatagtgggtgctattgatgttatctagcaagactgaggggccaactttctgagttcaaaccgtggtttttccacctgtaaatgaggaacaacgataggactggcctcagagataacccatgaggactaagttggttaatgtagagtacttagatagctgcctaaaactatgtaatcattatgtaaagataagctattattaattttaatggtcataatttaaatgaacattctaggatatagttgcagacattgcaatacaccaaagtcatttatgttataatttatatgctatccaggagagaaattgcaacacagatgtgcaggcaccccactatcaccccaaattaatattatggttattaattcaagacctataaaatagcatgtgtcatttataaaactctcaaatgtccatatttaaaaacttgcttaaaattcttaaaaatcaaaaagttaatgggttttgaagtctcttgttaaaaaaataacaaatcagtgtaaatgaatgacagtttaatatcaaaaagatgaaaagttgatagccaagtaacaaatgaaattgttaagcagggttgaaaaattaccaagtgcaatggaaaaattaacacagggattttatatttgtaattattgattaacttcttctattaattcttattttgacaatatttaaagccaaatattggcatatattaaactgagaaccgaatccttaaattgctgtatctcagggtactaaaycaaaattttctaaaacgttgaaacaaatttcactcacttgggctttattgaagatattattgctttatcctttagttagaatgatgttattataatgttgtttctgaagaacataccataattaattaatgttaattccccatttcttttatcatttagatttctacttttagtgtatttcatgaaggacatgaaacattactattgaatgacatatacaaaaagttgaagatgtgttaatgttcttttattaggctgatggaagtaatcaaacatatttattatttatcttaggtgaagtttaaataataaagtcttgtatactattaaactatatattacttttacttgtcaccatcttttctctaagcctggtttagaggtaaaaatcttttcaaattgtgtggcttcaacttccaacttgctcaccttctctgggtaagagttgaccatattctatcaaggacacaaatactgtattccttcttcccagggcatttatatagtcacagggaaggccttagcctgccttttggacttccctatgctttaagatttttttctttatgtacgataagtagaagaggaagaaatacatcaaaagaagtttcgctgcaattcaactaccttattgaccttaacttcctcaatcaactaaaagtatctttctacatcattcatttcagcatttttccttttttcttatttatttgtttttcttttttcttttctatcatccatttgacttttgtcacagatagattttaacagcttgcattgtatgttcattttcctaaaatattagagcttctattaaaagattggtgtaaagaaattaggggtccaggcggctcatgcctataatcccagaactttgggaggccgaggtgggcggatcacgaggtcagaagattgagaccatccttgctaacacggtgaaaccgcgtctctactaaatatagaaaaatttagccgggcgtggtggcacgcgcctgtagtcccagctattccggaggctgaggcaggagaatcgcttgaaccaggagttgcagtgagctgagattgggccactgcactccagcctgggcaacagagcaagactccatctcaaaaaagtaaataggataattatattcttatattcattaacatattttgatggatcccctgacatgaataagggcagagacggtagcaagttaagatgggccagttggatttcatgccttcaaggacctttcattcgagcataggaagaaaaataagagtatacatatttataatacaaggccaaatgtttgaaatcgtgaaagcttccttctgtatctcaaagagcaatcaactctggcacaagtgatctacagtgactttgtgggagcagttggcatctgaaaaacatcttaaaaaacagtctataacttgtatttgtttcttttcacttacatgttatgaaagaagagaaatagagcctatgtctgctatctcctggaccctcccctagtacatttttccattgctaactttartctacagcctttcactgtaataaaccattactaagagtgtgttagtgtttctaaattctttgagtccttttagctttcactgaatctaatatttgtgttaggacccccccacacacccctaaaaaagaggctctagagttcgtcagctgggacattcaagtggccaggcccaatatattcagaaatgctgacttccttacaaaaactaaaagctttataattttcaaaaaaaaccccaaacctagtttgaataacacataacaagttttgagtgaacgcttagcactgtctcaccatgagctcatggattggaggacagtggcagggccacacacgtgccctccctgtagccaaatgtaggccagtttacagacatcaggaagttgccactgcgatgcagtcattcttgacctctgtgaagaaattcttccagttaaaaatttatttatgtctacaagcatcctctttcaaatgcaaccaccccgtggaatattttaagtctcacagaaaagtcacctttattttagcatgaaatggcttaaaaatcagattatttttcttcaaacatcagatataatttccattaaggaaatagaagtctttatagtgattgatggagagaagttattttggcataaaaggaaaatgtgcttgggtggaataccagagcagacagctatgagctgtcagagagaagaacttgtggggagcagaggagaggggaccttgaaagctgggagagaaaggcacaaaaacagcaatgcaagaagtatattttaaccactttcagtttcactactagctgcccctacagagtgattgtgattaaagaaactcttactaaccgatttttaacccgcgctgagtcttccatgtatcttagcttgattttttttgccctcaatcacgtgtctacactagatcaagtgcaccatctaccaaatcaaacactcgtttttaagtagggtgtaaactgtcactaaggaatgtttgggtcaatgtccacctatagatactgctctcactgtacttgaggcagtattggagaacttatgttttctatggaagacttagagcattactggaaaagagacggctttgtttcctttcatattaaatgtcaaggagaggcggtaaagcctctcctctgtttttctatagaacccagttcagggctgtgtctcatcacttactatcctgtgtattattaatgatcaattcatctactcctcaccagactgcaaagtttttgaggaaagaactccttcattctccactatctacacagactacgtataaattaacaatgaataaatgaacaaatgccttcttcatatatcttgactagtctatatgttgttagcattatatttaaataccactttttcataagagttgtggattagaaaactgtgaagggattgtttgtttgtttgtttgtttgtttgttttccttaaaaaattaatacttgcggccgggcgcggcgggtcacgcctgtaatcccagcactttgggaggctgaggcgggcggatcacgaggtcaggagatcgagaccatcctggctaacatggtgaaaccccgtctctactaaaaatacaaaaaaacattagccgggcgtggtggtgggcacctatagtcccagctactcgggaggctgagacaggagaatgacgtgaacccgggaggtggaggttgcagtgagccgagatcacgccactgcactccaccctgggtgacagaccgagactccgtctcacaacaacaacaaaaaataataataatacttggacaggaagaccacagctatcacttctagatctaaacattcttcaagatgagtggagacagaggtagagtgtgtgctggatggatataggagtggacttacttggttgtcatcatacggttgtaccatttctttttaataatgactgaagatgacattgggaataaataaacatagacctttgagtttcatagccacttaactccctagttttgtttttcaaattagttgagaggtgatacttatagccataactttaataacattaccatcatcatctcaattgtggcagctacaatgtcaagaaactcacaaagttaaaatgtgaagaaactttagaggtggtttggtgtggagaagattgatgttgatacgattcatgtatctttcaggattccatgggattgcactctgtcatcaatttgctctaaggactaagtctgaaaaaacttattgtgtgtcattactgaaatactcagcagtggtttggtttctgaatacttttaaagcattctctctcttctccgcattataccataaaatatatcttagcatattattgttttcacttgccatttgtttaatatatgagaatatattaaagcatatgccttgaatcaaatgctaaccagattaaactatatctaagagagtgtgtcttttcaaaacagattgtgaagttgtgttctggttcccatattactgccattgttcaatattttgggacttctattttggaaatgcattcagttccaacttgtagcccctaagaaatgctccctacatctaaaggctaagatgccctcctttattatttttctgatcaaatatttaagaaataagcttcaaatatttgttaaatttttctcaaaagtaaaatttttatgtttaaaatatgacaatctaattgtcatctttaatgtattaaaatcttttatatccagtttttattttattttatttacttatttatttatttgagatagggtctcactctgtcacccaggctggaatgcagtggcacaatcttggttcactgcaacctctgcctcctaggcccaagtgatccttccaccttagcctcccgagtaactgggactacaggcccacatcactgcgcctggctaatttttatatttttagtagagacggggtttagccatgttggccaggctcgtcttgaactcctgacctcagttgatccaccctcctcagcctcccaaagtgctgggattacaggtgtgagccatatattcagtttttagaagatcattagaattcaaatgttgccagactttaagtgtgggtcactatctgatggagggcttctcttagaagatgtccccaatggcagggccttgttataaaggttggaagagagataatcctctgactaagaggccagagaagcagaagattttttttcatcagatttcacgtcagtaggaagacagaaaggagaaggaagagaaggcatgaacagcatatgtgtgaagtagaatcttaatagtgtgcatcttttaagtcaggattccgtctactgttggccaaaataaatcattattatctggtggttggaaaaaataaggacattccttggttttctccaaaaacttattttggtgtttcttaattacccttaggagaccttaatgatcaacactgtatcaacagagaaagtggaattttattctcttatagaacagtgatgttattatgcaatgtattcacataattatttacagttcttcagttctagatgactgatactacagaaacctgagataatccctgcttccattagtttgggtggaacttttgttgagagacttgagtcatactgaataccttgaattactgccaagagctggtgatcatcaagcttgagttaatatcaatgttatgttgctatggagaggataactgcaggagaacaatcatcatgtggtaggttttaccacgtggcctgctgaactccatgctcaaactccaactacttttaagtaatgacattaaaaatcatattttccatttatctgtggaagctagtgagtaaagaataagatagagtctactgaacctatagaatgttactaagtattaggtgttgtatttaatttccagtttgtctaatgctggaggcaattttaccttctcctaccagtgaaaaagtttatgccagtaagacttgtgatttttgttctcccccaacacatgcttctatataaatttattatgggaaaagtgatattaataaaaactttctggaacaattatagatagagtgtggtctggtgtgacagatattttgtttcttcacaacattcattctctgagtattcaccatggatcagatattctgtagtttctgtagtagatacaaaagctttacaaggtgtatttttccacaaagaggttagctagattaatagtgagaggatacatcaaagaacatggaaatgatttttagagaaatgagagcaaatactaaagtattgaattaagtaaaacaagaaaaatagctcctcccaccttcaaaaacattggtgagaccaggattgtggagggcaccttggcaatgggccttgtagctcagtgaatggataaaatgtgtacacagtgagaagagaagaaagtgtctacacagaagttagtttttgtttaatttgatattttctctttacctcgttctagtcaagatgacctgaagccttctagtgaagaaccagccaggcaagttccacttcttagggccgttaaatcccttctcttattaatgatgttaattgcatttggatctccatccagatatttgccctaccttaatttcatgttaatgtgccatgggctaaagaggcagtattttttaaacgcatctgtaagtttcatttatgacagaatttctgtaataaaagtgtagtcaagagtgttgatggaaaattagggtgacataaatacgtgagaactggaaaatgtataatcttaaacagtacacattatttttattatctctctttcccacaggctgatgaggcctgggatactaatatnaaaaaccaaaattagaaacttctcctctgtggtgtttattgcttcgcctgcagtgcatgacatcttaattctaaagctctnaactcacaaaatctgacatcgttttaccctctgacacgtcaaaatcagggcctaattgntcctgtggttgtgaattatgaacaaatatactttctaagaagatggatttttcatttaattttccttttcagcttcacaatatgtacatatacagaggttgcctgcgattttaatatgctcacacctacaaaaacacacaatacacacaaactttcaaacgtaagcacacagatctgtaaacatacacatgaagatttgttgcaacacaattcattctcaaatctatttcctgttatgcttatgattaagatctataacttctcagggttgatttatttgttttgtacgagactgagtaaagctaaagaccacgaatatgatgggtgttgctaaaataaacttctcaagagacatcaagttttaatctgccatatttcaaatattccctgttgaaatataaacataaaggaaccattaattatataaaaatagaaatacatttgtgactttcagagctgtcaccgaatagatattggaaggcaggttatttagaggactcatgtaagacagaaaagaactacgcacagatcaccgatgatgacacagttatgtggagaaagtaatctgccacaggtcacccagacagggagtgggaaagtgatggctccgtcctcgatcacttttatatccctttcattccaaagccaagcatgttctataaaagcagaaatctctgtactcttttgacatcctaactccttctgctaccctcatttaccctcatacatgttttatacagatgtgggcttgtcagaaaaatcacaaaattttaatgttagaatggaccttatcatgctattttagttatcagctgctgagctgttttctatgtttgagttcccttctctctaaaaaatatacaaaaatcaatagaactttcagtgcacttgcaggtgggttttaccttttttaggccttgatctcacagcctgatccttaactcatctactttccaatactggctgacagagcatccaccatccaaaggcagcgtagacaaaggttcaatgagtaggaactcttaattatgacataatgacattaataacttttaccttatgttttatgtttttggagacaaaataattccaaacttattattataaccataaacataaatatttgtatcattaataacagtgtaggaccttaatttatagtttaaccattcacatttgagtctttaatccctgctcaattccaaatgtatacatagttttaggggtccatttttatttctctccacatgtagtgatttatgtttctctgtaccttctactaagtaacctggccttattccattatatatttagtttccatatatacatacatctgtctctgaggacttttaatttcatttcattggtcaatgtatctgttcttgctgttgtaacagactactgctactaatactactgctgaattactattattattattattacttttcagtatttctaaagagctttttaaaaatatgtcattaagttactgttttaagtaaaacattttatatagagattcatatacatattgaacttatgtttttattttcttgcatgtatcttaagtgatcttgaaatcaacattataacaacctgataaaatagagtgaaggtttctgatctttgctcatttgcaggagcaccttatataagatgtaaattaggtaaacgtttaacatttgggagaaattcactatacaacaatctgattctgagactccaaagatcgttttttatgtttaaaatatctatttctctattcaaactttcattttatttgccgcatctaatatctgacacatttccaaataagtaaaaacaaaattcaccaaatcttgtatcttttaaaatgtatctttgtttcctgtcttctatgttttgattatttcttttaaatttttaaaataaatttgtgtttagttttgaaccataaaaataactcattcaaagtcatcaaagtaaaagtaatcatctcttaggcatatagttgtcagtaatctgattttaacccaacagactatatacatatttaagacagggtctctctctgttgcccaggctggagtgcaatggcacaatcatggctcactacagccttaacttcccaggctcaagcgatcgtcccaagtagctggggactacaggtgcatgcttccactcctggcaaatttttgtattttttgtagatgtggggttttgccataagacgaattgttgagtcaagatgtagatggcacattagttcacgttatttcagttaaggtttcctgagcctctactttgtgccatgatataagcaaggtgctaagtctgtgctgcaaacagcagtcatcctatccaaaccgtacacttacaagtgaggcaacaaaggtatataggggttcgggaaaaactacggaaagcgtgtgtgtgtgtgtgtgtgtgtgtgtgtgtatcaggcagaaaattatcctcacattttcctacgagtatcctagttgatcctctgccaccatgctctttccatgggtgccctttgctgtgtcctttccaccccacccttccagagggatctggatgtggatgcctatgctgagtgtaatgaagcctgagatgttgttagaatttaatgaataaggccaagtatgctaacattttttcaatccacaaaacgaaaattagatcttgacctacacaaaatgtggctagctcctctgttgagaaaccctgacaccagatctattaatacctttcctatggtcactttatgttttgaaagtttgctactatttggtgatgacaccaccaactaggatgaatataaatgttcattttcaaagatgttaaaggcatcattctcttatttctaataattaaataataaatgtggagatacacacacacacacacacggtttccatagtttttttttcaggcaaattcgctaaaatctcataaacattataattattattaactcctaggaataatatctacatttaaggaaagagtaattttaatttaagtagacacatttaatgatgcaagtatggatacctcatgcaaacaaatgcctttatacttactcagaataaataatgggaattccacatggaagcttatgagaaggtctttaatgatcttattttgctttggttttagctttctgagtaaacaagcccctacacactgagtattagattcacctggaggtcttatttcataatgtatccagggctttagccctagacatgctgattaagactggggtgggctcaagaatttgcatttttcacaaattccaaggtgatattgattttattcttagtagatcttctcattaaaaataagtgtaaccctctgcaattaacagaataaagtcaaaatctctatcgcaggattcaacagagggatgacaatctggcccaaccaccttgcatagctttgggacctaacattactcttgttttacagcagtagttctgccattcgtaagtgaaatgtggtctgttctctgaatataccattctctttggtatctttgcactttgatcttgctgtattttctggccagaaagcccttccacctttacagtttagaaactggccacttacccttcaaggccaagttccaataaagtttcttctaagaagagtgctgcctatttccaaatttaagtatataaaattgaggattgaggaaatcccaaaattccagtacatttgtttcataatgcaatctaagatcattctgttaatgttccacgtgcttccaacggctccacgaagtggtatgagactcaagttgaattttgaatcacaaagtgtattcattgtccacctgacatctttttttattttataccatgatttttatgtaatacatcatttgtgtctctaagagtttttcacgtggattttaataatgtgccaattcacaaaagaatttgacttaacacttctgagcattattcattgatacacagttgaaatacagatagtttagataggaggaaaagtcagtataaaggaatgaaattttttttaaagctcaacatttcctagagattttacttctcatatctaatggtgtaattctctcttattaaaaaatgtgttaatttaaactattataattttatcagatgctgatttcgtgtgtgtgttctgtgtgtgtttgtgtgtgtgtgagagagagagatgatctgatgtgtattcctaagtttacaagattctaaaccttttcacttataaatagatagttcagagggtgacatttttggtagagaaatcttaatgaagcttaaaatgcaagtttctgtgtagaggtaccatctggttaatctgcttcaaatgatggtggatgcaccatcattacccaaatgggtgaaagcctggctgcctatagtctcccttaaaggttaaggagtgatatatgggtgctaaagaaaggcttatcaggctactgtacatcagagcactgacaaaacttcctcaggaaatcaccaaatgaaacaaggacctattcagaaatgttggtttatagatatgccattacaatggaactcatctaaatgacagcatggcttaagtgaggaatttttactcccaggtcaggaaattctaaggcaggaactaatgcctatcttaactcttgagatgtggccagaattcaggttgtttttctactgtgtgctggttttctcagacatgtgaatttggggagataagaacagaatagcatattagctgcaacatgtggcacttgtcagattaacaaaaggagtgggaggcttcatacaagtctccattttccctgatagagtttcaagttgagaacagtataatgttcatattttacatcctgatgggaaaatgggtaagaataaaaggtgtgtgagccatagaaacagaatctgtttcttttcactttttatagcaataggagctaaaggcactctaaaagctcacttgaaggccacaaggccttgcttttgtcttttgttttcattttaactttctgcttttttacaaaaaaatctatattttgtcccattatttaatggcaagttgcctttaaaatgtatctggcctcatcacagaaatactaaggtatgtgattttgcataaataatcacagagaatggcatttcttaagttaattgtgtctttctcactaattcccatcaagagcgtgaaagctacaatttaggtgatctttcagacgattagtgtagtcatccaggaagtctcttttgttatctaatctaagtcactctagctataattcccccttgttttttttttttttttttttttttttttttgagatggagtcttactctgttgcctaggctggagtgcagtggtgtaatcttggctcactgcaacctccacctcccgggttcaaacaattctcttgcctcagcctcttgagtagctggattacatacacgtgccaccatactcggctactttttttgtatttttagtagagacggggtttcaccatgttggtcaggctggtctcaaactcctgacctcataatccaccacccccctcagccccccaaagtgctgcgattacaggcatgagccgctgtgcccagcccttgttttgttaggtgagaaaatgagcctgtttccacatggagggcagtggtggtgaagttgtattatgttttgaaaaatactgaaagcaaacagggagggaagcagattaacatgtttttaatcatttatgcactaatattgtatacaatgtgtgtgtgtgcctgtgtaaagaaagaatacactgcatgtaacacagtaaggtattgtatttatatattgctcaggcagaagatatttaaacagcctggattaattcactcatcttgtttgtactaagaaacaaagactgaatgagttacaaataaacaagttccccaaattgtattattgtggtctcatttgagtgtctcataattgtatatgtattgcatttatcacaaaagttatatttgaacacaaggtggacagttataacgtgcatgagcaaaactatagtgagccatatctagcgatttagctttccaggtgaaacagccactctagttatgtaaagtgataggaaataaatcaatcccatcttagcctaggacgacattgacatcagcatcagttattccaataactgcataatcaatatttatgggcttaatcaagagagacatgacacctggattcgctgcatgtgagaagggagggcaatgtcaaggtggatttggtgaagtccaggtggggaaagcagagtaaatcagcagcaaagtcaacaagcaatctgctcacagatccacaatattcggctgctttatagaacacagctttattctttgtctgtgatggaatatcaatgcttccattttgggaaaagtctaacgaattctttagctttttaaaattaaaaaaatatatatatagccagtttgtattttgtattttttataaaaggcatataaaaatgcaaagcatagtttctgtctttgagaagttttgaatcttgttggtgagtcaagaaatgtagaagaagcaattataagcaggatttgaatcctacctgtatcactaatttgttgtgttgtacaaatcaattcttgtgcctaggccaaaataaagcaaaaaaagactacactggctccacattccaagtaaatttactaattcaatggtactataaaatgtcaatgaatatattccagaaaataagagtgaaaaatttcaagaatgaaggaaaagaagagtcagatgtggtgaaagaaggcttggattagcaagcatttgattgatattaaaagcaaggataagaatttgctgaatggagaggtggggaggagtgagggttattatagaaaaaaaatgaagagaataggaaaacaaacacaggtgaaaaatgagcatgaggggatcacctgggattgagaagatgacatcaactgctggaaatggaagttttgcatggagagcatcaggtcagtttacagaacgccatggacactgaaataacagggctgggtttgaagctgttgaaaatttcaatcaggaatcctttcctatctgactcagagaaaaggggtgtttggaaaatgttcatctgaagcaggggggcggggcggggagcaagattaaactggtagctatcatttccagatatgacccagtccgtagaatgtttgattattaaacaaaaccaaatgctaacatcagcaggtccacaacaaacagaagatttacaatctcctgaaattgcaaagatctggtagaatagatttcacatggcaatagttggcagaagctaagttgcttctgctttccatggctctccttatctccacattgttgtgactgaagctggcctgctccccattgtcagcctggaacagaaaggtgtttgcatcagagatcactactgtagggaccatagatggacaagtgctttaggaaactactaccgaggtctcatcctgagatgagaaggctctcatttagaacaaacatggaaaggaaggattgtatgtgagttttgttttgaaagcagaatcaatatactaataattgagactgagtgaactagtctaggaggcaaaggagaggaactagcttacacacgaggaagcttaaaaatattgtttgtgtatattaaaaataaaataaatgcctaggcatggtggctcacacctgtaatttcagcattgtgggaggccaaggcgggagaatcgcttgaggccaggagtttgagaccaacgtgggtaacatggagagactccatctctacaaaaaatttaaaagttagcccaatgtggtggtacttacctataattctagcctactagagagtctaagatgggaatcacttttttcctggagtctaagactccagtgagctgtgactctgccactgtactccagcctggatgacaaagtgaaaccctgtcttactccaaggaagaaaatgaaaataatacttttgaaagtcctcagatagaagactcttacctgcttcattttattagtataatatatgacaaattaaaaatattaaatttaagtgtttatttgccacttactcaaaattttaggtatacacaggttgacccagaaaagaaacaaatgctaaatccaaaaatattgtcgtgcttcatgcctacattacttttgagtacacatatttcttctgtaacccattataaggagttttcaaaatataatatgttcttaataacttacattaaataattcagtggtaaatacaagttataatatattgaatgttgactggtcaagagttcccttttttcataaaacagatttcaattctcatgttagtttggccaactgaaagtaaatatgcttggtagaaaacagtctaagtgagacattattaatgaaataatatgtctgaaggtctggtactaatgctggatcacgaatataatttttgaacatgaagagctactaaatgtaactgagtttagactgggaaacttttccagtgatccactaggtactagtttagttgcatggctgaatgacccagctatttgccagaggagagggaaatgatatgtagctgactgtcaaatcatatgctatttattatagttatattttgtttgttttaactcttaagtgaattgtgagtttctgcaaatcagaaaattgtttattaatgtttgtttgtactgctgtgcttaattcaaaaccacctaatgagtgatttttgaaatcaacccaattcatacatgatgggtagatttaaaaaatagttttacattgtttcttatttcgtttagaactgcaatcccgagataggaagattgcttcaaaaactataacagatttctgaaattgagtaaatttgcttcaattgtctattaaaagttttgaagtataataaacaaaaaaatatattaagtaaagcaaggttcaaaatcacgtttccagtaaactttgcatttgcagtacatttatgtagacaaaacaagtccacaatagtttaaacagacattcacagcaggtgattccaagaccatgggaaggatttggttcctgtttattttctgagttgtcttggatgctctccttccagttatgtcttcttctctttctcatgtatcatgtcttatttcaactattctgacagcatgtcaagcattagcagcagaataatctgtatgcacagtgggagagagaggcagaccaaatacacattgaataaggaaaaagaagtttccagcggttgatacattattctccctagcaaagggctagatttgctaagcatatggagacatgcttaaggatcaatagggagaactttgaaatatatgcccatcctgtgaaaatttatatcttgactgaggatatgttttgatagtataagtaatattctcataaaatttttggagtgacacatgagaaatggaggaaaccataatgtaaaaagcacatgttaagtccttgccaatgattaagccatccttttgccttataaagacattgattttcattctatcctgatcttttagagtagttgggnttctatatatcttgagaattcctatgagaataaaacacagctaaaattagtgtaatgagcttaagttagaggaaagcaagataccctggatcttggataaatatacttggtttaacgaatttcttaagatatatccatgaggatatcattttccttaccaaaatataatgcatatctttatttatttgtttttttaacctcagagcttctagggtagactcaaaaaagacattctgctagccttatgttttactatgtttccataaatgctaacatttctttcaaatatttacccccaaggcttattttagatgtatcagctaagggagaggagtcagaaagataccttataatgaagtttcctcttctttttcttatattcgtaacaatccgataaatggtttctgaattatcgagtagacctctgagaactcagcaggtgattccaaatcaaattcacaaccttccaagatgacattttccttagaaaatcccagtatctaaccttaccaactggattaaaatcaaacttctttatgaaaaaatatacatcattaaattgtgaaatcaaatatagctctattaattaaaatgtaatggtaggaataggaaaaagtgttagtgtgcgttgtaatagaaagagatgacaagtgcgcacagctgaggaacgttccttatatttccaaggtctctgtgtcagaagttcgatatcaccataaccttttgatgggtcttagttaataaatagttcgttattatattttattcatactgtaatattgcttttaaattcgtcctcttcattcatggctgtctttaaatcaatagaatcagttaaaatatacagaatataaagtagaaaatacagcgtattttctggttagaatattatgttgatttaagacttaattgcattctgtgaaatttaggtttaatcattccacaaaaaaacacttttagaagcaaaagtgatgattaaagtattcaacaaacataatttaataatattggtttagttgacaaaataaaatgttgttgtgaaagcctttcttacccttgctctaaaaacggaaaataaggctgggcatggtggctcactcctgtaatcccagaactttgggaggttgaggtgggtggaggatcccttgaggtcaggagtttgagaccagcgtggccaatatggcgaaactccatctctactaaaaatacaaaaaaattagccaggtgtagtggtgtgtgcctgtagttccagctgctttggaggctgaggcatgagaatcacttgaacccaggaggcagatgttgcagtgagccgagattgtgccactgcactccagcctgggcaacagggaaaataagaacaaatgtaatcacataatttttttagttgccatagtgggtttattacacaagcatgtggtgatttatatttaatcataatttattgattatattaaaaaatagagacacaatggtctcacagagagggaatgaacatatattattttggctaactatattttatgagtaactgcatttacatttccttggttttgaacttagccatgctatgaacaactgaataatctttattgttatagtttcaaaatatttgaaattatctaatggctcttagattatacaataaaaattataaaacattatattgaaaaaatgtattaatattacaaaaccttacaataaaacataataatacagtgttgttttggcatgtgtctcttttatataaaaatcagaaggagaaaatccagttatttgttctttttttgagattttactaaattacaatgccctcaataatatgaagacatacaatttaccaacaagtggccgggcgctctgtctcacgcctgtaatcccagaactttgggagccgaggtgcgtggatcacgaggtaaagaagtgaagaccatcctggccaacatggtgaaaccttgtctctactaaaaatacaaaaaattagccgggcgtggtggcgggcgcctgtagtcccagctactcgggaggctgaggcaggagaatcacttgaacctgggaggcggaagttgcagtgagccgagatcgcaccactcactgcactccagcctgggagacagagcgagactccgtttcaaaaaaaaaaaaaaaaaaaattaccaacaagttgataatttcctacagaattaacgtcaccctgaagtttacccctttggtattacagctgtttatcatgtacataactccctttttattttgagaggggttaaagttaattcgtatctataatttatagagtaaaattatatttgttaacaaaataaaaactttttataatactttaatgaaaggcttattcaccaaagaaaataataaaaattacagtatctcatcaataatttggcagatatctcaactcttattttttctcgtattttaagactataaattatataaaagtaacagtattcattgctaaacagtaaaacaatttttttctgtgtttacatctagcttactgttttagtaataaaaatgttctcaattttcatgcattgcagtcacatccttaaaaaatctgagatttcttgattttctgtaaatttggcattttagtctgaattattaaacttaagtaaccaggatgtaaacttttatcgcttttttttcatttaaaattaagaatgacatctctctgagtttttatgtccaaaattctggatacttctaaaaggatgtgagcattactgcagggtagatggtaatcctagactttggaatacaaattaaatgagctgttctatctgaccattctctgtaacacagtttcagggacttgaacgacctgatttgaaaaacaagtatgaacagttagacataatgtgatctaaaggtagagtatttatgtataatcttaagttacaaaattatttgctgaaaactttaaagtcatatcgtatcttaatatatataaccttatttatatatttattatttagtcatctgcctttctttccaaaaatgctgaaaaataagtcagttatcttttccttcatttggggaccatgagaattttctctttgagaaatatgtgtttttttttttttgttttgttttgtttttttttttttgnggcagctctgtgagctcaaatttcttaggtttaatctaagaaattccaggagcgttactctcaaccatgaaagctttttgataggagtgaactgcagatgatctggctttggaacattaccagtaactttcaaagaattttcttcatgaaagtcagaatgtcagtgctgttgctaaaatttctggtttaaacatgtttctttttcttttttttttttccccagctgaaaatacaaggcaaacactgccgttcaaaaacattaaaaatccttgcttttattctcatattagggttcaatatcagtggatggaagtaaaatagtgtacacatcactcaaaataatcaatatactgagagctggtagccttactttgagttctcacttctgcttttatgtaagccttgttgcctatttggaatgtttttctacctgatacaggaaatgagaaggtgatattccttccagttgtaatcatccacgtttctatggtgtaaagtcactgtattccttttacccccaacttttactacgcatcaactgcatgccagttactggctgagttcttcacattaacaatgacattaaaatttcaaaatacgcatttgagatagggataaaaatggcagagaaatcaagcaagttcccaaaggtcacagagcccaataagaaacacaaacagaataacataggagtcagatcagtagccaagatttgatttgtgtgatcaccataatatagatcttaaaccaaaactgatggctacttaacttaattttgtgaaaagaatgaacacagagagaaagatgggcctcatacacacacacacgcacacgcacacacacagcatatttaactgcattctactaaacagatactctttcaggtgacaattggctagcctttttaaaattacttaattaattattatttctttttaagcagagtctttctctgaaacccaggctggagtgcggtggcgggatccggactcactgcaacctccacccccggggttcaagcgattctcatacctcagcctcccaggtaactgggaatacaggcatgtgccaccatacgtggctaattttttcagtaaagaagaggtttcaccatcttggccaggctggtttcaaactcctggcctcaagtaatccgcttgccttggcctcccgaagtactgggattaaagccttgagccaccactccaggactggctggcctttcttgatagaacagttaagttttaaaagcaaatgagaaatactctctttttaaaactttccctttgggatgaaattgtgaaattatagctaactaccattgactagacaaaactccaactgtgtttttggctttgcatttgttatatttaatacttgactcaagaaaaccttgtaaagtgtcttttgttattacagaatctagaagccctaagcaaatatatcactctttttctatatattaggagaatccccatttgccctatctgtattttcaaactttggggcttcaaatgtttgaagtaaattaatatttgtattttaatatttacctagtcaattttctaagaaattcaacttactaaatgcttaatgtcaatgtcattcaaacacaaagtatatatactacacttaattaaggattcatttacagagagtcatggaaaatataactcataatttataatttacaagtctcaacattttgcatatttttcaaaagggaaatatatatacatgtatacatacatacacacacatttagatatgaggtactaaaataaatataatgtaacttactaataaaatcaatgtattgcatgaattgtcaaaattctatatttttgctatactaattcaactcttttgtgccacattatgttagagtcacttatttctttatggagctgtcagagctagtttactcagtaaaatactctgtatgtttacagcctttatatgatattatacttaaatcatatgcaatataattcatattatgtgcaatgtaatccaaaygtattctttgaaacatttgtaatgtgtattcagtaaaaatatactgaaataaaaggtaggcacctggcacaatccatctcttagcccttctcacgttgtattgaaatgatttctatccaagtttcattgacctttagtctaagctcctatggggaatttcataccatgcttctacaactaaaatttaaccccatactgataaataattggtggtcaataaatatttgtttcagctggctgaagaagtaagcctttccaattaataataaaaattaaaattttatgggattttccaaataattagaatcagaggaagagcgagagagagagagagagactgagatctcaggcatatcaaccttgtggataaatagagggttatagaaatgaattgacaaacgtgctgtaaattgcttagctctgcgaatctgctaattctcaggagagtagaaaagacttgacatttatcaagtgtgtgtcatgtgaaacacttcgtgcaaggtaattttcactctttattccttttagtaccaataggtatcagatatcactgcacagttagctgcacctaattatccagctaatttttctacttatactttgaaatacgtcactatatgacaatggtaaactgtagcattttcaaattttaccgtatgacggttgtaaaaatgaagtttactacttttaaacattccattttaatttatatatatatatttgttttctgatatttattatcgcatatgaatgattttatatgtgattaatttatataacaaagtacaccattgaacttcatgaatatgaaatcataatctggtatacatagacttttagtaatataacagcattttaggaggaattatattatgagctgagtggcaaggataacaaattctgtcctgttttaattatttaagtcacagttttactagtagtagaaacaattctgaaaaaaaaaaaagaaaaagaaaaagaaaaagaaaaacaaaagatctggtcagatgtgatggttcatgcctgcaattctaataccctgggaagctaaggttggaggttgtagaattgctgaagaccaggagttggacctgggcgacttagtgagaccccgtctctacaaaaaataaaaataaattttaatttgaagcaatggtctgagaaagtgagaaattgtcgacttgtaccctggataattttatgcctgattttgatttttctaacatttcttactttaaaaattatccttgaaaatttcagaagtggcttcacacttaattttcatgatcattttcaatgtttcttccaaaaaatgatctacatggtaattattttatgtggcataattctctagttgaggagacacgatgcttttactccccaaataaaatatggatatatagctctttgtcatatgagcacatgttgcaagaatcatttgatatgtttatgctgaaatagaaccttaatgactcatttatatttccttacatccaattttattctgcattacgaagtgtttaaataatatggtataatatattgtttgagtctagcctctaacatcctgcaaactggcatcagaataatttacttttcctaagatttaatagtcacaaaaatattcattaaaattaaaaacattacatctggaaatacaactttgctgtttaaactgatcattgtactctactttccttttttgtaatccgaatggtaaggtataatttacaagttatattttataagttcataaatgaggagtaaattttgttttataaaaacaaacaataattgttaagttagtatttatcacagggggaaaggccttgattcaacaatccctgccaagttgcaagtctcaaatcctacttagatatatattacttgtttgcgtacttttaaatgtgccttccttcactacagagtatatatgctgatggctttattttttagcacttacattcatagattcctgccatatgattgcattttacagtataatacgaacatgttcataaagatttcatttgaatctattcacagtttttatatatactccatgaaaatgttatacttttaatatcaattatgtgatattctcaaattgtcattgattattctggtccattgttgagagatgttcctcactcttagtaacagtttctacatcctggaattcataataataacaagagacatttagatagtgtgatggttaatagtgtcaacttgattgaagtatgcaaagtattgttcctgggtgtgtctgtgagggtgttgccaaaggagattaacatttgcatcagtgggctgggaaaggcagacccacccttaatctgggtgggcaccatctaatcagctgccagcacagccaggacattaagcaggtcgaaaaaaatgtgaaaaggctagactggcctagcctcccagcttacatctttctcccgggctggatgcttcctgcactcgaacatcggactccaagttcttcagctttgggacttggactggcttccttgctcctcagcttgcagacaatctaaagcgggaccctgtgatcatgtgagttaatattctctaataaactctcctattatctatctatctatctatctatctatctatctatctatctatattctattacttctgtccctctagagaaccctgactaaaacacatagtaacccacagtattatttacccacatatagtaaccattagcttatttaagccataccacaaacctatgatgcagttgttattttccctcatataaacgagaaatctgaggatgacagaagttaagccatttgcttgagagtttttagctaataagtgaccaggacagaaattaacttatctctataaaatgttatttttgttaatattgaatctcagctatagtaaacaggatattttatgtacagactgggatatatgtgaaatgatttacccttatttatattccaggaaagaagaaaaatgattacgttcttctcaggttgttacttcataaacggtataactttttattttgggatattatgacaagaatatttgggctttggctgaagtggaaggacttgggactacatgtcaaattttattttgatagtaaatattgtgtccaagggtgcccatcctttaaagtatgtaaattcagggttacccctctgtgattatagaagacttatatcctgtacttgataatgggaaattaactaaatgattttccatataatgaccattagcttctcaaaggaactaaaaaagtgttaatgagaaaacacacatttttattgactacaaaccataatttttgatggtctcataatcaatttaaatatagaggcatatttataaatatcatttgcatttgttgttggatttttatttgatatattatttattttaatttttttatttcaatagcttttgggatacaggtgtttgttggttacatgcatgaattgtatagtagtgaagtctgagattttaacacaccagtcactcaaatactgtacattgtatccaatatgtcattttttatccctcaccaaacctccctcttctgagtctccaaagtccattatattactctacattttgcatacccagagttcccacttacaagtgacaacatacagtatttaattttccattcctgagttacctcacttagaataatggcctccagctccgtccaagttgctgcaaaagacattatgtttatggctgattagtattccatggtgtatctataccacattttcttttcttttctttttttttttttttttgagacagagtctcactctgtcacccaggctggagtgcactggcacaatctcagctcactgcaacctctgccccccgaggtcaagagattctcctgtctcagcctcccaagtagctgggactacaggcacctgccacctcacctggctaatttttgtatttttagtagagacagggtttcaccgtcttgcccaggctggtcttgaactcctaacctcgtgatccacctccctccctcggcctcccaaagtgttgagattacaggcataagccaccgcgcccagcctataccacattttctttatctactcactggtggatggggacttagaacggttccatatttgcaattgtgaattgtgctgcaataaacatacacctgtagatgtctttttaatataatgacttctttttatttgggtagacacccagtagtgggattgatggattgaatagtagatccccttttatttcttgactaaatctctacactgtttcccatcgagattgtactaatgtacattcccaccagcaatgtttaagcattgccttttcaccatattcacagaaacggctattgtttgttgactttttaatgattgcatttctgcaggagtgagatggtatctcattgttgtcttaatttgcattttcctgataactcatatgtttgttagccatttgtatttctttttttgagaaatgtctgttcatgtcatttgcacacttttgatggtttttttttcttgctgatttgtttgagttatttgtagattctagatattaatattttgtctgatgcacagtttgcaaatattttctcttattctggagatcgtctatttgttctgataactatttctttgctgtgcagcagttttttagtttaatgtgggccaattaatttattttgtttacgtttgcatttgcttttgaggtcttattcattaattctttgcctaggcctatgtccagaagagttttttctaggttaacttctagaaatttatagtttcaggtcttagatttcagtctttgatccatctttaatggatgtatgtataagttgagagatccagtttctttcttctacatgtggctagccagttttcccagcaccatttattaaacagtgggtactttccccaatttatgattttgtacgttttgtcaaaattaagtcagttgtaagtatttggatttattcctgggttctctatactgttcctttggtgtatgtgtctactgtatactggtaccacgttgttttggaaactatagccttgtagtatagtttcaagtccagtaacgtgatggctccagatttgttcttattgcatagaattgctttttttcgggctcttattttggttccatatgaattttacgtttttaaaaagtattgtaaaaatgatattggtattttgatagcaattgcattcaatttgtagattgttttggtcagtatggtcattttcatgatattcattcttccaacccatgagcatgggatgtgattccatttgtttgtttcatctacaattttgttcagcaatattttgtagttctccttgtatagatctttcacctccttggttaactatattaccaggcattttatttttttatttttgtatgtttgcagctgttgtgaaaggggttgagttcttaatttgattctcagcttggttgttgttggtgcatagcaatgctaatgatttgtgtacaatgattttgtaaattgagaattcactaaatttggttatcaaatctaggagtctttctttatgatgtaaaagagaagcaaaggccaatggagtgtcaccctctaagcctacccttacatcccagttacgttgctaactcagaaaaatcagctgaagggcacttggaaattccctactctgacccagatagtcttttgattaaaatcatatggttattagtttttattttccagatggaataaatgaagaccaaaagaatgtttatgtggaaactgtgtttccccaaacccttctgcagtagtcttttcactgctgaaatcgttgatatactaccattataaacaaacacactctttatttgttcacctaacctgcatgcctttattccttagaagattttcaatattttattttaaagcatactggaaagaacagaagcattaaagaaaaaaaataaataaagggactccccccacctccaccaacacacacaggtatcctctttctcaattcatcagtgaggacgcttggtcagtaaaggaatttctcatgatccctcctcctttctctacagggcatagatttgcacacgtgaagccaggcttcacatgactgtattccataatagcacaccaaaaacactgtcaaaatcaatgaaaacttcacaatataaagaatatagctagaatcatggtaatgatcagttgattgatataatattagataagtgcaggatggtaacttttataaactaacttttcaaatggctcagtgaattgtctaacattccatggcaaatttgtatgaagactacctggaactcagctatctacaatttggttggcaggggaactaggtttgtgagtttgtttcccccctctatgttctaatgctcagcaaactgtgaaattttccatgaaatataatagttacgtaaatataaaaaagcaaaactttttggtatgttaattattgcaccaacttgtgttgtttgactactattaacaataaactaaaacaattctacctgcttgattgaagcaaaaatgtcaatgtgtaaggatgatgggtagatcacaaaatcaaagaaacagctacatagtctgactcagacaggacatgtcaaacagcatccctgtaaggaacttagtctacagactcacataggccctgcctcaggaataaataagctgcacgtgtgttttgcttccttgtattctttgatgtcagggtcagatactgggaaagagactcagggcaaaaaaagagtatattgattgacagcttcctcaagacagcccacaatagaaaagacatttcttttcaaagaaactgagtataattgtcaaaaaagaaaatagatactggtcatcaaagcaagaccttatactttgtcaaagtttactttaaatgtcacctcctccaaaaagccattttctcattcccctaaatcattctcagtatatctcagctttcattaaacaagcatgggccatgtatttaagaaaacagaatttacgggaggacaagacagaccagaccttaatttcagggaacataaattttgccaaagatgatattgccatactactatttctgtgattctcttaggatcctgatgccttgtgtcttagttatgttttttcttaatcagaagtttaaaaagtatattatattttattttaagttctgtgatacatgtgcaggacatgaaggtttgttacataggtaagcatttgccatggtggtttgccacacttatcaatccatcacctaggtattaagcccagcatgcattagctatttatcctgatgctctccctccccacaaccccgaaatagaccccagtgtgttgtttccctccctgtgtccatatgtttttattgttctgctcccacttataagtgacaacatgtagtatttggttttctgtttttgtgttagtttgctgaggataatggcttccagttccatccatgtccctgcaaaggacatgatatcattcctttttatgggtgcatagtattccatgatgtatatgtaccacattttctttatccagtctatcattgatgggtatctgagttgattccatgtatttgctatggtgaatagtgctgcaatgaacatatgtgtgcatatcttaaacaaatttgtaagaaaaaaacaaacaaccccatcaaaaagtaggcaaaggacatgaacagatacttctcagaagaagacattcatgcagccaacaaacaagaaaaaaatctcaatatcactggttattagagaaaagcaaatctaaaccacaagataccacttcacaccagtcagaatggtgattattaaaaagtcaagaaacaacagatgctggcgaggctgtggagaaataggaacacttttacactgttggtggcaatatcaattagttcaaccattgtggaaggtagtggggcaattcctcaaagacatagaaccagaaataccattttactcagcaatcacattactgggtatatgtccaaaggaatataaatcattctgttatcaggaaattttaaagcttctttgtgatgtgttttattagttaaaacaataatttattagttaaaatgttgtgtctttcctaacacttaccacatggtgtatcatgcaatgcacactaatgaacgcttcaaaattagccttaaatgcacartctcctcacttgcactctttgcttatcttgtgtctgatggctcttctgcatgaacaggaaaatctgaattctcacaattatttctaaagcttttattaccttcccttaacccaagcccagttttattacctgtatgacacttagacagtttacattgtaatcccaccctctaatggatttaaactcattttccactttggtatccccatatttagtcattatttgtacttctgttattgcagacccactccaccttgtgttgcagtgtgtgtatctgtgatcccctgtagagtgtgagttcctagagtcagagtatccagggatagctctctttaaacatctaatgggattctatgaacataatgaaataacatttatgttagctaaatgtataaagagaaaatatatacttgcccctttattaaagttgttgtttcatattattatatgccaacaccatactagtcctattgacagagagttatatgtggtatttgtattacctttaaagatattagagcataaaataattggaataaactgttaggacaaaataaagaggtacaatacagacactgaaatgggattggccaattctacttagctggacagaaaagctttctagaatagatgaatctcaaaggataaacggaggcataatccttgcagacaagaagaaaagtgctttccaggtgaaagaagcagtggtacaacgaacaaatatacaaaggatgaggaaggtggagcatccaatttaaggatcaaaataacaaataattaaattaggttatttagaaggtaagatcatagataaacacacacatgcatgtgtgtaatggaatttaaaatcattttttaggtaagaaagattcgttggaatgttttagagggaagaattaagtaattctatacacattttagaaagctcattctgatatcctataaagaatgtgtcaagtgtgaaaattagtaagatgaagagtcagtaatagtgaatctaaaaatgtgaatgagcacaagagattattacatatatatgtgtgtgtgtgtgtgtgtgtgtatacatatatatatatttttaatccaaagcatatggtaactgataacaggcgggagtattagaaagggtcatccaggttgaatccaggatttcatgggagatagaaggaatgaacagtgtttccagacactgagattaagaatgtgagaaaagaagcagttgtaagtgtgttgaacttttgacgtctatacaaggagtctactggttactagaaggtttacaaagagacctaggtggatattactagtctttgtgacattatagtgtactggtataactcttggtgctatttggggttgctaaaaatgaaataaggaagggaaggggacagaagataaaaatggagggaggataaaggggagaacatgagagtggcaagttaaaagtagggcactagagcagaagacagaaggaaagcgaggcatacaaggtaagggaaaggtaagaaggaggcgagaagagaacctgtgtgatttccaacatctaagtgtggacaggagagattgtctgtaaaagggagaagacatggtcacgaggaaagggggtgctagcaaattttcatcatggaagcctaaggtaaaattttcagagaaggatgtttaatgtaagtgatatctaaaatggccaagatcaatcatgatgataagtgaacattcagataaagtttcagaacagataaaactctgtaatggtgacagcagccatcggagtggttacatggtatggcctggggagggatgtggggaatcctggggtgttgaacatggcctatgtctcaaagtggtgaccaatcacattaccgcacttcatgtgctttgctataagcaggtcatccctcgattcaaaatgtgttaaaatgtaatacgaaattaatataacacctaagagggtaaaaaatattagtggctttctcggattacctgggtaccatcagctgaaggattcaaaccaaactctgttagactcagatgccttagctgctgaccgctgtactactctgctgtcaaatccaatccttgccaagcctctccattggcatgttaaatggacttagtctctgttgtcccttttagtcttattttgaaggcacctacctattctaccaactgataaattgaattgttattactgttttacagtaagatttggtcagaagctttggttagaccataattttttgtcagatctgttgttctgaactctccattaaggaactgtttagatattacatatacttttgctgaaattcagaggtactcataaatttgacgacttttaaaaaaatgtactatcagcagtggtaaatgataactaaaatggtataatttatcttaacagtatcttgagcttaacaaagcttcagataaaaacaagattgcattgaatatcatgcaataaaaggaaatacttaaagcaaaggtatttatatgttcttatgtgtatgttcttacagggatggaaaagtctattttcataaaatctaattttttaatttacaatatagagccctttgcttcttttcctgtttaggttaagatcttttcttctcttgaaagattatgtatattttaatatgattaatcttattttacctttacagaagtactgtgaattagcagggcagatattatgacatctccttaacatatgaattaattgtgggctgccaaatagtacatgatcttttactggaacgtagatccaggtggctcaaatagatatttaagggcagagcacctaaactgaccagccaatgtaagcagttcatcttccgagcagatttatttttcactgtaaccaaatgtatttacatgctcctggaaaaagtgttctcccgtgagctttgttagtgtgttttcaccaaggaactgctatctgggttgcccacactgtgtagagtttttgtcctgaaaagctaaagtccatatattgaagaaaacctaccacataaagatgtttcctagaatacccgtcatgatcaaaggtttgcagctgtagtggaactaactaatggatgcttcattttagtaagggcctcttttcttccattgatcatagttgaatattgtggtgtcagtttaagatgagtccatgtgtgacatggatttaaatacccaaatttcagtggtttgataaaaattataagaaatactgcaattatctcaaactaaaacttgtcaagatttgtgtaatatcatagaatgtggacaaagtgattaaaaaatatattctattgactctgtgacataattttagcagatacatctttatattggccaacctttctttgaattaatcttgacttacgagtttagaatagtgtcatgtctggagagaaaaagacttcatgtgaaatataaacactctatgtactattttagtattaattttagaaagatatttggcacaccttgaaacgtgatctaatatcactttcaattctaagtctattgcatcatcaagcagaattatataaactatttttaaaagtttatcaactggattttatgttattagcaatacatgagatgtcatggctttaaaaggatggctattttattatgtagtatccttcaaatattattttagtagttttttgtactaaccataggccaattaatgattcagaaatatatttaatttctattttataaatcttatattcatggcaatatactacccctcactgatttttgcttggctttattaaactgagtttctgttttatctctgcaaaatataataaaaaataaaaatatgctcaaatattaagcaccccataaatattaggtggataaataaatataaccaaactgctcttgcaaaagtgaaaaagttttaaatatagagatttcattccattccctttaatttttcaaaatattagatgatacaaaaatcatgtgcacaattcagactcatagctatttttagaaactataatttttgattcaaaagaaatctgcaatcttgcaaaaatgagactcagtttaacagtgtatttccaaagaaattgtagctgttattcttgcctttcttcttagacaagagacttgtgatggtatctcttaatattccatacgtaacaagaaaaagagcagaaaaagccatgggaactataaatataggcagtgatattgtggtattgtggttgaaaacattatctggaagtgagaccacaacaggttctcgttctagctctccatctaacttccatctctagagatgtgcccttgacaaaatgattttttcctctggactttaatttctttatctggaccaggtaagctcaaagatctcagtttagtatttgatttttccagattaaaatctaagatgtggtatcagatacacttttctatttttcttttatttgtcagacaaacaaggtgaaaatgtgtttaaaaactaggtttatccatttttttcctgtacagtgttcctaattcaacactacatttttctatatacttttagtagaaagtgaatcataagttacttcagtaggatatatctgttgttttgctcttgtactcttcctttactattactattatttcataacataaataatgttaagagatctgggtctaaatgtaggatttaatttttyaagtttttacaaattctatgaattccctacagtttctttggccgtcactatttgtctggttgtttatagaagccgagaagcagaamccctatggctgaagactggtcctgatagagattcttcttctaatcttctcaaaccaggaaggtgttcaggtcactctgtaaatgattcaaagacagatactatgtaaagwtacatttttcctttaaaatccagtctgtaagcaaattttatgccttattttaaataacaagatatgtagctttggcaacatgtcatcttatttggataggctatgccaacaggacccaaccagagcaagccaaaaaagatctttgaatgacagacagcttaagaagaacagaatctgttagagaaaataagagaaaaggagaaatgtactgagcagaccaaaaaaataaaataaaatagaataaaaggagcttccacacaaggctgttgggttcattcaccacataccaagggaacactaccaagtaaatattataaataaaatacttgctggagaaactgaatatccacctgtaaaataatgaatcagaacacctacttcacttcatgccatatacaaaaactaacccaaaatagatcaaagatctaaatttaataagtataaatataaaactcctagaaagaaacataggtgaaaatatgcaaaagtttttattagggaatgagttcttatatatgatgccaaaagcacaagcaaccaaaggaaaatcgataaattagattttatcaaaattaaaaacttttatgcattaaaggatactatcaagaaaatgaaaagcaagtaacagaataggagaaaatatttgcaaacatatgtctgacaagtattaagtatctagaatgcttcaagaactcttacaaatcagcagtaaaaacacaattcaattaaaagatgagcaaagttcaatattaagctattccccagagaagatacacaaatggccaataagcagtgaaaagatactagcattagtcattagagaatgcaaatcaaacctacaatgaaatagcactttgcacctactaggtggctataattaaaaaataagcaaacagaaacaaaacaactattggtgtggatgtagagtaatcggaatcctcatacattgctagtaggaatgaaacatggtacagccactatgaaaaaagaaatgttttcagttcctcaacaagttaaacatagaattaccatatgacccagcaattccgcagctaggtaaatgcctgagagaagtgtgttagtccattttcacactgctgataaacacatccccggggctgggtaatttataacataaaagaggtttaatggactcccagttccacgtggctgaggagggcctcactcacaatcacagcagaaggtgaaagacatgtcttacatggcagccagcaagagaggatgagagccaagtgaaaggggctttgcccttataaaaccattgagatctcatcagacttattcactaccatgagaacagtatggagaaaaccacccccatgattcaattatctcccaccatgtcctttccacatgtgggaagtatggtaaccacaattcaagatgaaatttgggtggggacacaacaaagccatatctgaagtaagacaaattatctcacaaaactatacaccaatattcctagcagcatattcattataggtaaaagaagaaaaaaggcacatgtccattatattcatacaatagaatattattccatcataaaaaggaatgcggtagtgttacatactacatgatgaaccttgaaaatattatgctaagtgaaacaagtctgacacgaaagaccacataatgtatgattccatacagaagaaatgttcagaacaagtaaaggcacagaggcataaaatagattagtggttgccagtggctggcgggagatttccattaacagctaacatgtacagggtttctttttgggttatcagaaaattctggatttcatatttattgttgcagagcatagtgaatatactaaaacaaacaaacaaaacactaacatatactcttgtaactggtgaattttgcttatgtgaaaaatatgtcagtaaaaatgctaaagtaaaacaacctgaagagttgactatatatatttgtagatatacacaagtatgcatttagcttttataaacaatgtcttgttaaattattactagcaattttatagtcagttaagattgaatacatgtttaattcctgcctttattgaatattcattctgcaactacttgtgctgggcactgtcctaggttcaaataatttaacaataattaagagagacatgcttcttctagaaaagatcaatgatttgaaaacatttttatttcaggacacttttatactcttgaaaattattgaggaccccaaagaactattttttatataggatacatccatcaatattcactttattagatattaaactgagaaaaaattttaagcatgtgttgaaataataaactattttaatataaataatgcatttattaaaatattttctattagaaacattttagagaagagtaaaattatttcatatttttgcaaatattttgacatctgactgaagagaagattttcagatttttacatctgctccagcatttagtctattgcaggctcttgttttggttaaaatgtatgaaggaaattttgccttgcacggatatggaaaagagaggagtatttcaattaccttttcagaaaattgtgaatatatatgtatatatatgtgtgtgtatatatatgtgtacagatagatagatagatgatagatagataactacatcagcactaaacaagtggtaatttcttacatgtttgttgcaatgtgtaatccggaactgtatcagtgaaattcttataacctgttacattaaaattgattggtcgttctttcactttgaagagatcttttaatcaaaagtgattttgcagaattttgcattggtcatttggaaaaggtttgttcatgaagstttgcagattttccaattgttgatacattttatgatacaaataacacttgttaataccaccactgttctcaaaaggagttttaagtgtggaagccgtaagctgccaagctaatggtggcacacacacgttttccgaaattctgcttttcacttgaaagctagaattttataatgaataacaagtactgtcagatgtttcccttagggtcactttgttcatgtttgaaaaagaaaagtctgccaaatgcctacttatgaattaccatggtttgtcagtcattctctcaattagaagcgaagagctaccaaaaagtrggcagcgaactctcactccaacgaccgcatgagcgcyccctgccgtcaactgtcacgctgccgtgcagcagaagtgctggatttcatctgaggatgtgaaaaaggcatgtactcaggatggaaattccacataatgaacacttttcgctgcttcatcaaggacgtgcttaactaaaagcagcatcgtttttggttgtttgtttacactgggtgtgtagcagtgaagacttcagtggcacctagtgcggtagctcctcgattcttcatctgcactttcgccattgatgcgccactagttttgctccccttatgcaatgttagcacagtgaaaaagacaaatacatttcgttttgttttgttttttttgagatggagtctctctctggcgccaaggctggagtgcagtggcgtgatctcggctcaccacaagctccgcctcccgggttcccgccattctcctgcttcagcctccctcccgagtagtgtagctgggactacaggcgcccgccgccacgcccggctaatttttgtatttttagtagagacagggtttcaccatgttggacaggatggtctgcatctctttacctcgtgatccgcccaattcggcctctcaaagtgttgggattacaggcgtaaacgtttcttaatattatggcaataaatatagttttggctccagagtccccctaaaagtgtattgggacacccagagacctgcctgagcaccataactggataactgctgctctagattctaaaactttctctgagttgctttatcaattgtccttttcttgttttcttacacatgggagattcttcctcattgtctctgaaaatcctcatgtttcttatggttattttatatggcttcatgatgcacacacacatccttatatatattttcttccgaatcttctctaacatgccctcttcttgcctatagatcatgacagtattctacgtacatattttgaggagtttttattatgttcactctgggagagctttcgctcctcagggtacaggagacttgtgaaccccagagtcagtggcagtgcctgcactccctagcttgctgctcacatcggtagctgaaatgccttagtcttgcttcagttatttcctttaaatagatgctaggtcgaataggtgttgtggcctcttagtaactgagtgatgggagaggtcatttctttgcttataagaacacactgctttctaagtgagaagagcccagcttcctgacagagcaccattagaagaaccctccactgtccttgttaggttatagtgcttatcaatttctctcctttacagggcccaatccaatgagtgacctgttttgggaagcaaacatgttaaaagaaaccctacttgaaagttaaagactacaattgcattttagaatatagactagtgctaccaattgtgattgtcctcctgaacgctatgcttttgtgacagttaatggaatttaaaaaggaaaagtaaacgtatctataacctaacttttgtaatggaaaggattggattggaatggaatcctaatacattatttctctcagaattaagtccattgttcttaacctgttattcttcagtgacctcgcaggactgcaagctacctaaaactgaatgtaagattttgtgagttttttttttttttccctgcatgatatatagacatatatacactggggaaagaatatcaaaaggtacatttgttttattcattcaaatattaaatatccaaatatttcttatatacacaggtataggtatttagttattggatggtaaaatatatatatttttatatgtatgttttggtcatttcacttggtaaaatagagcatcagtgtgcactatggacagaagcagtaccatagttttttcctcttatatcaacttttcttctcattccctcttttttcttctgatccatctccttcccctccctcaattccagtttgtttttctcttttaaagttggctatggacagcaaagacaagtgaaatgtaatttaaaatacgcacatttaacatattctatattataaatcatgctgctataaagacacctgcacacttatgtttattgcggcactattcacaatagcaaagacttggaaccaatccaaatgtccaacaatgatagactggattaagaaaatgtgtcacatatacaccatggaatactatgcagccataaaaaatgatgagttcatgtcctttgtagggacatggatgaaattggaagtcatcattctcagtaaactatcgcaaggagaaaaaaacaaacaccgcatgttctcactcataggtgggaattgaacaatgagaacacatggacacaggaaggggaacatcacactctggggactgttgtggggtagggggaggggggagggatagcattaggcgatatacctaatgctaaatgacgagttaatgggtgcagcacaccagcatggcacatgtatacatatgtaactaacctgcacattgtgcacatgtaccctaaaactttaagtataataataaaaaaaaattcttcattgacttacatgcaatgaataatttataattagcctatgttactattcattttccttttatttttttcttgcaaaattatgttagaactgtgactgaaatgtatgagtttctcaatagatgctattgattgagttattttgaagcacaaaaataaattgaattggttaatatacactttgtaggtcaaaactggccctgggaattattttttagagctattccacattattcaacttcgtaagcttactgttggttatttatatatttttaatttttgaattataatagaagcagtttaggacttaaatataaaaatatgtaaaatgtaaatacactcatttttcattttaaacacatgctttcatgtcataayggatcccaaaataccaaagatattaggggaaaaaataaactgttgttgtcttaaaatacattcctttgttgaattcatcctgctaaccctttagggtattgacagcctattatttttcatatgtgccatctttatctagaaaactgagagaacaactaattatatccttttgcaaatgagtgcaacagaatggcttttgttcaacacaatttttaagtctgttgaacaggactgttgaatggcttaaaaatttgccatggggtgtgtgtgtgcacatatgagaatatgtatgttaatattcagccaccttagtgtcatggaaagcgtggcctggggatttgattatacattgtgctttgtcataaatttaatggtttctttgcaacattattggagggagtatgcctctatgtctttcatttagcttgtatatttttggtatgatagacatggtaattactgctcttaaagtttgtgcaaatgccactgggaaaggggataggagtaaagaattaaagtgaaggtcatgaaataaacctattaacaaaagcagagtgatttcttgaataatcccttcatctctccccatgtcataatcctttctcataaataattatacaagcaagcctagacacacactagtgttgaagaattgtgctgcaaaatgcatttagctgcattaaataccaagagaagccttgagttccaaaacctccttaaagtggaattctcagttgtttccagagaagaggcaagttatagtacatataatctattatgaacgtatctgagtagaacaccatgcaataaggcgctattgaattgggagggaggtatcagagctaaagagcacaaagacgggccatcgagatattagaggagatttctcttcatatgtaattctgctttacatgtttcctcaatcttatttcctttctccctaccgcctcttttttttttagccacaaatcattgcgtttgtacagattacaggaaaacactcaaatattgctcgaagaagcataatctttcttctgcagttggtaataaatgagatctacttgtaaaaattagtgtcattgtctacaacactttcagatgactctcatgccaccaggtcaatattcctgctagggatgagttagttcttacacttgggtgatcaccaagaatgtgggactcataagggcaatggatgatgcaggcgcatagtgtcctttgatgttactggaggtgtaaaatgaaggttttttttcattctaaatcaaagtttaatggtatagtaagtatttattatctttatcctggaagggattttattgcttttgacatttttaaaaatgtcaaattttaattttaatttaattgtttaaaacaatttttaaacttttatatrgttttacaattcagtggaattctctcttctttatattattgtacttgcattaataatattttagatgttttcaatcatgagttattgtcactatgttttattagaaatatccttctcactatgagataaagggacgaaatgagtgctaatgtaattctacaggggtcagatagcatttccatggttacattgattcactagcagcatgtcctgaataactcctgctgtattgcaaaccccttgcgggcagggtctagtatatttttaatgtttctgcatatagctccaatttagctccaattttcttcctacattgtagtactagatcaaaaaatacttattggttgaacctataatgtatgctacttaggcagctctggcatgaggcatgacattatattttaaataaagaaacacattccagcattccaaaattctcaaagcataaccctgtgtaaaaccatagttaaagtttcaaaatttgaaacacgaaaactgactttttaaaatgttaaccatacaatgactaatgcagtgtgctctttgcacgtgcataaacaataagaaacattattaaaataaaatatttatattttaaagtaaacatacactatttaaaatactgagcaaacatttatataagtaggggatttatataaaatctgaatgatgaaagtacttaaaaagtactaatagtaactaatttattgaatctttgtggcagtcttcatatgaataatttaaccaccagaatagttacggaaggtaggtacaaatgaataacccatttgtataggagtaaactgatgcctagaaagagaaagtcactaattcaagctcatacaacgtacaagtagaaaagtgaggattttagcacaggtaatcttgatacagaatgatttccattatttttaaataagagtaatacatgtatgtatatgaattcaaataatacagaatgataaaaatggcagaatacggagcccccttttccacccctcgagttccttctccccaaccaatatttatattaatagcttattttatttatcttaaaaatattatattttacactcattatttctatctatatctctatatagatatatatcttcatcattataaaataagatatacagtgataaacctttctcttaatatgaatggatgaactgatctaccatatattattagtagctatattgaattccgatgtatggatgggcctaattatcttttttattaataaaattttagtttgtttatatcattaatattctcatattttgctatttgcaaaatatgctggaataaacaagagttaattttatttctatttactgtaaattgtgtcattattactgaagtaaaaggattgagatgacataatgcctatcagtgcctttaaaatatttcaataacaacaaaaaagaaacctctttcaagtgtgcaacatcctgataattaacttatctgggtaatgagtgtatgaaagttcattataaatgatatttctatgtgtgtgtgtatttagaatttttacaatagttttgtcaaaagttattttttaatgaagcatctgatttttagggagggatctaagctttccacacatgcttctattctccatagtagtgtaagaatttcaaatgtggacacgttaaagtatttctagaggaggattaagtgatatgaatgaaactgttggggaccttacattttatgtgtaatgagagctgaaagggggttctacaaagaagtgtgataatagaggacagatttttggaatgaggtaatgtcattccaataaggactatatttatctagggatattttgaaagaaactggtgatgaggagaatgaagagaaatagtcattagtgcaaacatgtcaagaaagaaaacatattacttctttggagatattttctctctctctctctctccccctgccttcccctgtccctctctccataaggctctatttatctatccatcatctctgcatatgtctttatccatacttatatctccatactcatatctataccgatatctatatttatatctgtaagctgatcttagcctactcatcatggtaacatatggcagatttgtgtatacctgttatcagttcccaaatctttacacacacttctctgtcatcatgattaaggggagtaatgtgctcttacgtttttgagaattgggcccaatggggacagctatttttctctgttataagattccatagattgtggcaacaatggcaccatgatgacttctaaactcttgatgggagacttgcttctgtgacttaatggattattagccctgcaatgggaactacacacccaaaggccaagaggaacatgcaaaggcaaacagagagacaagagagcccatcaatcacgagaagatggcaggaagttgtgccgttcccattgcagttattcggacagcttaagattgaaatataatagaaagttatatgacgtactctacagacaagtttatattttattattattattgttttgtaatgtagaaaacatctacccctaaaaatctgtggataataggttactagattttgtaactaaataagataatagacaaaatataatagatatagaaaaagtcagaaatgatcctcatccattttagaaacccaatcaatttcaatttaatccaaatctcttccttcttcaacaaggcactacgttatcctcatccttccagctttccttcccacagctttgatcattcagggttagtcttcattgcccatacttgttcctatttgttttaaataaagtcttaataaattcttcctattgggtggtaataagatatattcaataaggtgaaatgtctaactttaattactgaacaatgaagcatggtagaggtttatactttaataatataatttattaattatacatcatggtccaagggctctactttaattaatattttccactagcaaaaaataactatcggtgtacaaagtcccacagattagacaccagaaccttaggcaggtagtaagcccccagtagttcagtggctaaagtgggctttaagtacctaaggtttatctttattcatgtgaaagttttctggctagagagttaacagctgagtgcatttttagtaaaatactgcaggaaatggctgataaaagtatcaatgttgtatatctgcttaaaggagatgcatatctgttctttctcaaaccactgttaagctgtcacccatagacttattgtagaaacaattatctcacagtagttttatctccagacatttttctgcccagacaaaagaatctatggaagtagtcatttctctagtttgttttagggaggattgtgttggttctcctatgagaaatcacttgcacattatgttcaggtatacaaacacgtgaatgtatttgctatacagagtccatttcttacacacagcaaggtatagtttcaaattgctgaagccaaataaaccaaatgggaagaaattgatggtaaactttgtcagaatgttggttctctctcatatttatgaatctgtcaaaggatagactttttgtaaactaataggtttttatatgttctaattatgcaaggaaatctatcctgtcttagcaatcaagtggtaagagagaaacatatggttagagatcagggaagaatatgttaagtgaataggacactgaaaaagtctgctgtgaatacagtggtgggcagccattgtgagattaagtagtaaatgcccatgcaaacagaaaaaaaaatggaattgtaatataaagtcacaaatataatttgttgattgacttacacggattacaaatttggtatattgagctttccgggcttagtgaataacatcactctttgcatttttttgctacatcatctggccacaaaattttaaagactatttatgaaagtcaagttaatatttaaagtcacaaagagtcctagaaattttgaacatcacactgacttcgtacctgttgtactatggcatatgtctttagtcaactaattatttttctcgttaacaaaaaaaaaggaaataaaaaatcccaaaaaacaaataacccaataaaaataatgagtaaaatatcagggttgatattcctcaaaagaagacatacaaatgaagagcaagtatatgaaaaaatgttcaacatcactaatcaaaaatcaaaaccacagtgagataacagctcaccccagttagaatggcaattctccaaaagacaaaagataacgtgtttgcgaggacgtggagaaaagagaatcattgaacattgttggtgggaatgtgaattagtatagcctttacgaaaaacagtatggagattcctcatgaaaacaaaaatagaagtatcatttgatccaacagtcctactactgggtagatatccaaagaaaatgaaatcggtatgtcaaagaagtgtctgcgcttccatgtttatgacagcattattcacaatagccaaggtatgaaatcaacctaagtggacatcaatggaaaaatggataaagaaaatgtggtatgtatacacaatgcaatactattcaaccataaaaagaatgaaatcatgcgacaacaccaatgaacctggaaagcattatgttaagtaaaagaaaccaaacataggaaaacaaacaccgcatgtttcactcatgtggaattcaaatacattggtcacatgaaggtagagtacaatggtagctgtcagaggctgggtgtttaggggagaaatgggatggagagatgtcggtcagagcatacatttacatttgatagaagaaatgaatttcaagagatctattatatagcaaggtgactctaattaatgaaaatatgattctattcttgaaaaatgtagaatgaatgtaatatgccatcaccacagaaattgtaacagtgcaaggtaatgcatttgtgaattagctagatttaacaagtcaacaatgaatatacactttataacatcatgttgttcatgataaaaaacatacaatgttatctgtcaattaaaaaaatatctaggaagaatctgtacagaagattgtgggtatttataaaatgcatatttactttgtaagtcaccaaatttgtgaataacattattggatttattttgcttaatagaatagaataaataatagaataaattataattaaatatttaaagtgatccctttagaccttgatgattttataaatataggtgagatgctagtttgcttaccctaaatatctattttctgccccagaaacaatcctttaatagaacactttacctttccttaacttccatcaccaaaattggcaattaagaatattttcacacagaaaaaaccactattgatatgtgtgtatttttagcaagaaagccagttttttgagctgtatgatggagccttttcactcattagtgatgcaactgacttctgcacaccatcctacagaagaagaaactcatgttcgtatataagcaaaatgacatatcattacacataataactcattgtggtgggttctaagcaagtgaagcagtactggctaaatccatcagtgtagtattggctctctattctacctgttcttaaaaccagtaaggtagagttcccgctccttgatataagaataaggattccaccttctcctgcccctcccaactagaattctcaaatgtgtttgtcggtggctcatccaatattgcccaaggaaagtgtgttttattagcttgggattccatctgtgaagactggcatttctatcttactaacagatacagaacatatgaagaatccctgagttcctacatagctgtcaagaagtaaatgaactgatttgactgttattcccttcactcactggaaaaatagctcttcccagaatcaagtattgttgactctgttccaatcctcagagcaattcttgccaaacttcttttgagaggtgctgccttgagaaagcatgacctatgaaaatgagttgaagctccaaaccagcccataccacgtgatttgcatagtacaagcctcactgatgatcactatccaccatatcttagagatgggatttagaagttactcatctctggagattgtatcccagggtctagcacaagtctctacacaagtggtactcaaagctagcacttgcattagtattagctgagaattttttaaaaaaaaatcggagaacgaagcaatgaagtaatagtagaaaattcctcttcatgtgaaattcctgctaacatgttgtacagcatgttaggatggggaccacacctcctttttactcacccattatagcccaacgatggaacacagtgcctgacaataagtatgtgttgagtaaatgaaccgctgtgatcctcccactgcatcaccgcaagtacctttagaccccaaagagcataatacagatatggtttggctatgtcctcacccaaatctcatcttgaattgtaatccccagttttcttactgggttcagaaagagaagtatttttccccacatgtggaagaagggacctaatgggtaactgaataatgagggcagtttcccccatgccgttctcgtgatagtgagttcttacaagatctgatggttttgtttgttatttgttagtttgttttgagacacagtcttgctctgtcacccaggttggagggcagtggtgtgatctcggctcactgcaacctctgcctcccgagttcaagcgattctcctgtctcagcctcccgagtagctgagactacaggtgtgtgccaccacgcccagctaattttatgtattcttaatagagatcgggtttcaccgtgttagccaaggcggtgtcgatctcctgtcctcgtgatccgcccacctcagcctctcaaagtgctgagatgacaggtgtgagccaccatgcccggctgatctgatctgatggttttataagcatctgtcatttcccctgcttgcacttctctctcctgtcgctgtgttaagaaggttcttgcttcccctttatcttttgccatgattataagtttcttgtggcctccccagccacgtggaactgtgagtcaattaaacctcttttctttataaaataaccagtcttgagggtatttctttatagcagtgtgaaaacggactaatagacaaagaaagcctcaaggaaagaaaggtacattgtagaatatcaaaatatctcagtaattctttttcataggaaacgtggcttgatcatgtttgttcattgagaacccactctattggctttgtatcttgcttcaagttgttctagaaattccaactattattgaggcatttgcgtattaaattactttttagaaatctttacagtgaaggtgaatctggtaataatacgtaacaacattatgctaaccactttaatgttctagatgtatttgataagaaccttattctcagtattctgagtaaactcggggcctggaaaacatttagcctgtacaaagatgtatatttgttatatttttcttaattgaaagacgatatatattttgaaaaaaacatttagtctcctaaaattataaaaaaatcattgtttagagaatgcaactaatctcaaaattttaaataaataaccagtgcttatagtgtagttgtattatccattcataaaattgattgcaatatgttagtgctggcagcttagtataacacattttcccccgaaccacaaaaatgtgtttatttatttattcattttaaaactactttatagtaatatacagattaagtaaacattttagtaatgagcttacagattttatacgatcatgcggttttggttttcttactgggttcagaaagagaagtatttttcagtggggattgcctagctgcaaccttgacattttcactgtcttgctgcagggagttcaggagcatgtataagactattctatttaatttagttttacaatctcattgtatctggcaatttaagacatagaaaagtaacttttccttaattaaaataaacttttggtatttggatagcaggataatgaatacccagacaggcagtatgtggtgatgagtagtgcatgaactttggaattcacagaccttggcttagatttcagattctccaattattagctatgtcagttagggcaaattgccttaattctttaaactcaatgtattgatgtggaaaaaggggcaataaatcctatcattcaaagttgtaatgagcagtaaagtatatgaatatgtaaaaatgactaggctagtccctgactatgggacatagcatttatttccatgtgcactttgtgtgagggagtgtaatatccaatttctgtattatcatactgcaactatgaatatggacacaaatacagatacatctttaccatttacagactacttttccatgtacacacacatagccctttgctaaaatgtgatcatggaattaggatttcataaaattgaattataacattggaaggccatgtagcttaagattaaaaacatagaatttgcagacagacacaatgagctggaattctattctacttgtttcctgtcctatcttgagcaagccactcaacattttcagtctctttctttttcatgtaaatgtacatatccatgtcatagatttgtgatgtctattaaggaagatgtatgaaagcactgtcacaatgaccaataaaaggagaggattcaataaatggtcattgtcccttaacagatgtctttaaaaatatattaaatttgaaacattgtttcagagtgtcttattggatgaaatgataataactgtacacatgggtgaagattagtgattggaagtcaagaatttttgcttcagctccttgaccttgaggttgaaatttaagcctcctcatctagtttttttaaaaaacgtttctaacagaaatatactttgtggatcattatacctcattctaatccagctccctcaagcttaatctgtatgaactttggggaaaagataagcactgtgaataagttggcatgcttgaacattctttgaataagtagaaaatattgctctttcattttattgacagaaagattatcttgatagcttatacttctgtttttaatgtaaataataggtatcaaattctaaaattgaataatgttgaccaatttaatgagtgtctgtaataaggggaatttataaatgttttgcactaattgcagtttgtaaagttattgaacttccttttatacttagatgataatttattatttatttatttatttttgagatggagtcccactctgctgcccagagtggagtgcagtggcccgatctcagctcactgcaacctctgcctcccaggttcaagtgatccttctgcttcagtctcctgagtatccgggattacaggcacgtgccaacacgcccagctacttttttgtatttttagtagagatgaggtttcactatgttagccaggatggtctccatctcttgacctcatgatctgcccacctcggcctcccaaagtgctgggattacaggcgtgagtcactgcgcccggaccaattttttatttttattgacaatgctgctttggataaagaaagttactgaacgccttggtcaatgcaactgtggtaaagagaacagaaatgatcatgcacaatagcaagatttcagttaaggttcttggttgcaagtgataaaaatttaaagcaggaaaataatctattagaaggctatggaatagatgtcagagacaaatgttaaggttctgaaattgggcaataagcaaggaaggaaagacctcaaaggcattaacctgcagtgcttctgaacgtgggctctggagctgaagttccaaatcttcgctccaccacttaatagaactttgtgacttcgggcaagtgacttaacctttgtatgtcccagtattcagatcttcaaaattagactacccttacagctaactgagttaacacgtgaaagacacataatagatcttcaaaaatgtccagaaaaaaataaatgtggccagaacaatggccatcacattatacaccatggactccactggacgtggttatggaaaactaatctcgctgtccttttgaatttgcatacctccacaaagttcctgacctatattggattttgccttggttgagaggagaacagaagggatgaaatttctttactttttctctaagtgaaaggtataattccctgaaactaagaagaggagggatttggatgttaaacagccacacattttgaaaatgtccactacagttagaataaccatatatcctagctaccttgagaaagtcccagtttacaactgatatcccacatggttaaacacaccttcgtggcagaagtgtcacaatttggatgataaattatggtcactgtgattgtcattcactcccttttgctgctaaaatgtgcatatattcttcttcttatacttactggtccagtgaaaaaagaccttaataacaaaattaaattttcatttataaaaacaataatgcatttattcttttcagcaaacaaaacaaaaacacaacaacaacaacaacaaaaaaccagaaagtccaaaatactattattctgctatctctaagtcttggatatctgtggactattttttgactctaattttttctaatcctatctcagtatttcatcacctacagagtaaattagcatcgtccccacaacaataccctacatacggtatctatatctatttatatacatgtatacaaatatatacataaatatatatatgcatatatacatatctatatgtatatagatagatgtagatatatgaaaggtatatctatatacagtaggcctccattacctcagagacacatctcaagaccctcagtggatgcctgaaaacgtggatagtgccgaaccctatatatactatgtataatttttttctttgtcaccatttcacagataaaagattcattttgctgtatatcttagcaacctcagcatatgatttttttccctttctttattaagtcaagaacttgcatcattttccttaatggaagcactttacagcttctgtttggcatagccaaatggccagtatcactgcttttgtgctttgaggccattattaagtcaaataaggatgacttggacataagcactgaaatagtcaatctgatagctggggtggctagtgagtgactaatgggtggggagcagagacagcctggagaccctgaacaaatgaatgattcatcccgagtttgatggagaaagagcacaaaacttcatcaccatactcagaacagcacacaatttaaaacttatgaattgtttattcctggaattttccacttaatatttttggaccatggtttactgcaggtcattgaaacctaaaaaagcaaaactttgaataaggagaaactactctgtgtgtctacatgcacatgtataagtagtctctctttcacacacatatacacatacaggaaaggaagagaagacatgtggattctagtttcctcatttccatacttgattatgaggccaaattgagtatttatgacttgcctccttcatgacccagtacatactccctctactttcrgggaacacttctgtaatatgctagaattttcatgcctaaagattctaagggtttttctttttacatatagaatgaaaagagtctttcattaacttccaattaatgaacatgctggttctgtacaccatctaccacccagaacgctgatctttcaagatgttgtttcccatctggcactatagtgagttttccatgaatcatccagtattccacaagggctacacagtaagaaccttgaatcctatgggaataagctcaatgcctaacatcgtttgcattatattctttgtttagtagcaatgatatataaaagttgtggttatagagtttgttgaaaatatctgaagaaggtacagacagcaaaggcagacacagaagaaaaatatatcaattttttaacagcagctgttctactgaaggcaaatcactgcactctccatgattcaagaaatcaactaccacccccccaacccccccctcaccacacacacacgcagtactatttgctagcatcagtcttgctcctctatcagggcctctaggttgtgctcagtatgaatgaattagacactcaggggtgccattagcttggcaacctgtccattttaccatgtcctaggcatgtttctatccataagacctttgtcacttgacttaataaggagacacacagtggccaggaaaagagatatttcatcacagaacctgctgccatgttgcttagaaggagaaggagctagatatgtgactatgtgtccattcttgagccctggcacttgggttgtcttgatggtcaggaacttggaaggaagacaattgaaatattgatgacaagaaaatttggggaagagacatgtggctataactctcagaatgaaccaaaacttgaagatatttttggatgtttaaaaaaggatgacctcagaataggaggattttaacaattaaaagaataggatgacttgttttgtgggtgccagtcagcctctttactcagtcctccctgtcacttcccattgggctcatgactaaaatagccattgtgtcagggatggaggttacgcatgggctcagctacatggacttacactcaccaaggctgccttcctactatcagtctaccagctgtagagaccaacactgtgcacccaatgtgacactattccccaggggatcaggcatctacctggtggcaggcagatcacagtggacagcctccatcatggaaagggaagtattttgtttctactggataagattttggatgtggatgtgtctgtcctgaacacaatgcttctgccaaacacggacttacagactgccttatgcactgtcgcagtattcctcacggcatggcttctgatcaaggaactcacttcacagaaaaagaagagtgccaatgggccatgctcatgggattcaccggttttatcatgttccccaccgtcctgaagcagctggcttgatagaatggtaaaatgaccttttgaagacagctctagccccagctaggtaacttcacagggcgggggcgagggtctctagatggctgtaaatgctctaaactaactatccgatatatggtgtcattaatttttatccaaattcatcttcttcacctgtgtattatcaatagaaaatagcttaatttgtcaatctatcttgggtcaaagtttaccataaagcttttcatgaattttagtttcaaaaatttacatcttatgtaatagtgtgtatacatttatatagtaagaaataatatagtaaagaaaatcttaaacacatggctaagtttggcagaatgtcataaagatcacattgtacaacaaatgccagaaattatagtgctgtccataattttgtttctttgagactgattccactggttttcaaatattgctacagttgaaacaaaattaaaagaataaaaactcagaatgatcacatagagtggctaaattaatgatattcaagttctgtttcttcatctttataatcacggtgttataattgtttatttcaaatcaaccgctcaaacacaggaatccatagcaccaaaaatttttgatacagaaacttcactgagggcaagcctaaatgatcccaaatctctatgaaccttttcttgaaatgaatgcatgtaactgagtccgtgtttgtcaaggccatttgtaaaactggaagttctctaatttaacatccatgtaaaatacaatatttataaaacaacttgtaataaatgtatgttaatttgatgttacatatatatgtatatatncaattacatatatatatatataattaaattcaagagaaaccaagtgattgtttaggactgagaccaataaaatatttaataaaatatttttggagggaggacttgtaatcacgaactggggggaatatccacgggcaaaccatgaaccagattcaggacaatgtcgttgtcctctgaatcccaggtaagtccactttgactcttaaatggcagaaggactctgggttttcaaaacccataagcctgttatctaacgtattttcgtttcaccagtgcacagctcctcttgtttatggatgcagatgcctttccagaaggctagaaattatagaaataacatttggtattttcagagtctgtatatggaagtacctacctaccatgtttttatttaaagaattttgaatatgtgatttgactcaaatttgggaattgtgtgaggaacaaaactattttggtggcttcaattaggtctatatgcaatagaacgtgaatacttttcaaaaacagaaatagaacagtgcctacgtgagctagcaccaattatggtccttggtactccatggcctatttacagctacattaatccatgagtcttataattcaaatggctccagtggctttgatgttcattagggacacaacagccctttgccttccctggagaagtgctgtgttttgggttctaacaacataaatactccccagtcccagtgtttttatggagcccaattcaatgtacgatctccccgtggcatcacctacctataatgattaaggatttgggagattcatttagtgaattttatcaagataacaatcttaacaaacactgtagcatatgcacactccaaaggctttccctctttctacgttaaatccaatggattcctgggactgtgtctcttataggcttttactgggcctaaattttagccaataagcttgtcaaacagctagaaacacattaaactcttcaagcttacctactctatccatgctcttcgggtaagtgtccactttgaaattcaccccaatgcaatcttttatcttggttggatgcacaccttcagaacctattcctaagaaattcttgcatatattgttggcataaatgtcttgcaattctgttgttatatcattttttttctgagtatatttgacccctatttaatgcttagctcttgctcaagttctaggactgcaggcaatgaagactgggtaagtaggggttaggatgagaattatcttctcagtctgaggtaacttcctcatatgtaaaggctactaaggcaggtttggaaatgggtttatatatgcatttccgaatatcctaataatatttggctgcttacattagtaaaaatcattaaagttgctttcactcaaagactgtaagatataaagaaaagttatttaaaatgtaaagcattgaacagaaaacaatcggaaactaatcaatgaaatgggtatatataggaggattccaaaaattcggagactctaaccagtgaatccagccttgctagtacatccctgcagccagatacagttgcacttgctggaccactacaacatcgggtgccaatctaaccactgaatccaacctccttgtacatsactgcaaccagatgcagttgcacttgctggaccactacaacatcgggtgccaatttaatactttcttcttttcactctctaccccrgtttcagtatccttggcagtatgctatgttcaactgactttgagatgtatgattctattttgacaccaacaggcttagaaaagagtaaactgaacactctggcttttgtagggagaagtagaactccgtgtagcacgaagtcttatgcaaaagtaggaagcagtgtaggaggattggcagaccaaaaaatgaaaagtgacaaatatttatatacagccagataattttgttataagtcaatactctagattttttaaatctcccatctccaaggcaatttaggcaacagcaagtatcttataaaattctctttttttagaaaatatagatgaattatttaagatggattatcattatttattgtgtatttagtataggtttatttatctcacacttctttgtctttttccattattttcagctgttcaaaaattctgcatttgtaacaacttcctcaatatgtaaatttaaaaatccctcaatatttgccatcttattctgaagtgtttaccatcttactctaaagtaatctgaacaccacatgcattattgttggagttttaaaacattagtatttatctgatcctaatgttttattgtaattgtatagattttttcactaattttggaagggtaaactattgtttcatagatgcaataaatcctggaaacttgtttgcaatacttttaaaagcagttttcaaaatttctcctctatcacacaggagacacactgtaatgactactatttcctctgatttcttttaggtgcgtttcttttgactgtattttcatcagtctcatcatttttctgtgtcatccatttgcgctgggacttgtgcctactgatggttttcaagtgtggctgcaatttggttcccttgaaggtattttaaaatatgctgatgcactagtaccattcccaaaccaactgaaacacattcttcaatggcaaggtcatggtgctggtatttaaaacaaaaatcttcctaagttattttaatatacaactacaacatattcactggtatagataatattgaatacaaaaaaaacctatatgatgactcgttccttctgtgagagagcaaagtccacaatttaaaaaaattaataatactgttaactcagagggatcagaccaggtggaaagcacgaatatgcactctgcataatgaagcttatttccagtgtacaaatctacagcaagcagaaaaggatacttggtgcrgtttgctctagatacacagctaacacagcgagccatgcagtggggcctccacctagaggaactgattacaggaagaggaagttttgatttcaaccttgttaggctttccttccagttagtaatggtttcaagctgaatggatgacacaacatgaaaaattcaactacttaagaatagcatgcgccaagtatattctataactttctgttaagattcatttcacttaataattttctatataaatctctattaatttaagtttctgaataactgtagggtcaacaacatatttggtactctcctactttgagcttggttgaaccacataatttgaaagaggatattttataaagttaaaatcctgataactttaaagactgataaatttctgtttgcattcagaatatagtggcagaaaaaaatattcctttctaaattataatgattaaattgttttgatggtattatgttgctataaataatttcctagagatattaaggtatacttacataagatttattcacatttatgatattttaggctgaccttaaaaattatttatgaatttaattgcttatgcatatgtgataaatgctaattataatatttacttggctttaataaatatttccagttgcaatttgataggctaactgtatgtaaaaatttcataatattgtctagaatagtttttctttattctgatcctttttagttatagtcttatagatatggccttagttcaaaagcactatacactcgtgaaacatttctaagtcaatgtaaaatattgtaatgtgatgtcagaataaaatctttttgaagatagagattttcatggtttttttccaaatcagagtttaaagtagtcaatctcatgatttgtcagacttgaaaagttatagaatgaatattttaacataaaaataacttaaatgaatatccttagaatacaaatcaactgtatattcactcgaggcacttaaaatattctatatgccaaaaactgcatatctctttccaatttttaatactgctttctctctctctctcttagtttacaaatatttctcaatatttaaacttttagaactgaatcatgttggggaaatgaagtctttggggaaataatttattatgaaaaatttttatgtagttattaaaaaaattctaactcagttaaacaatattatatggaaatgccatagtttgaaaaattgtcaaggttaagataaaacaaaaaaatatttttgactttttttttcttttcttttattattatactttaagttttagggtacatgtgcacattgtgcaggttatttacatatgtatacatgggccatgctggtgtcctgcacccattaacttgtcatttagcattaggtatatctcccaatgctatccctcccccctccccccaccccacaacangtccccagagtgtgatgttccccttcctgtgtccacgtgatctcattgttncaattcccacctatgagtgagaatatgcggtgtttggttttttgttcttgtgatagtttactgagaatgatgatttccaatttcatccatgtccctacaaaggacatgaactcatcattttttatggctgcatagtattccatagtgtatatgtgccacattttcttaatccagtctatcattgttggacatttgggttggttccaagtctttgctattgtgaataatgccacaataaacatacgtgtgcatgtgtctttacaacaacatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttcatggggttgtctgtttttttcttgtaaatttgtttgagttcattgtagattctggatattagccctttgtcagatgagtaggttgcgaaaattttctcccattttgtaggttccatgttcactctgatggtagtttcttttgctgtgcagaagctctttaatttagttagatcccatttgtcaattttgtcttttgttgccattgcttttggtatttagacgtgaagtccttgcccatgcctatgtcctgaatggt

SEQ ID NO: 2 - DNA, 995 bp, Homo sapiens
  5'UTR 1..253
  CDS 254..304
  3'UTR 305..995
  polyA_signal 971..976
  allele 53: 99-16050-235  : polymorphic base G or C
  allele 228: 8-135-112  : polymorphic base C or T
  allele 282: 8-135-166  : polymorphic base A or C
  allele 388: 99-16038-118  : polymorphic base A or G
  allele 447: 8-137-152  : polymorphic base G or T
  allele 477: 8-137-182  : polymorphic base A or G
  allele 643: 8-130-220  : polymorphic base A or C
  allele 659: 8-130-236  : polymorphic base A or G
  allele 831: 8-131-199  : polymorphic base A or C
  allele 894: 8-132-97  : polymorphic base C or T
  allele 961: 8-132-164  : polymorphic base C or T
  allele 976: 8-132-179  : polymorphic base A or T
gtagagtgaagcaagtaatgtgtgtgtgagtagtcattggatacatacataasagtgagcaagtttatcagctcctgcatggcagtgttctgatgatcttttgctgcaaaagagctacaccccaaattagtggcttaaagtaaaagcttactagtgtatatgatgattctgttggtccaggatttggaaagggcatggcaggaggtctcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 3 - DNA, 1035 bp, Homo sapiens
  5'UTR 1..253
  CDS 254..304
  3'UTR 305..1035
  polyA_signal 1020..1025
  allele 53: 99-16050-235  : polymorphic base G or C
  allele 228: 8-135-112  : polymorphic base C or T
  allele 282: 8-135-166  : polymorphic base A or C
  allele 388: 99-16038-118  : polymorphic base A or G
  allele 447: 8-137-152  : polymorphic base G or T
  allele 477: 8-137-182  : polymorphic base A or G
  allele 621: 8-142-132  : polymorphic base C or T
  allele 700: 8-142-211  : deletion of TTTG
  allele 743: 8-138-218  : polymorphic base C or T
  allele 759: 8-138-234  : polymorphic base A or G
  allele 839: 8-119-38  : polymorphic base A or T
  allele 894: 8-119-93  : polymorphic base A or C
  allele 898: 8-119-97  : polymorphic base A or G
  allele 921: 8-119-120  : polymorphic base C or T
  allele 926: 8-119-125  : polymorphic base A or G
  allele 996: 8-119-195  : polymorphic base G or T
  allele 1001: 8-119-200  : polymorphic base C or T
  allele 1005: 8-119-204  : polymorphic base G or T
  allele 1011: 8-119-210  : polymorphic base G or T
gtagagtgaagcaagtaatgtgtgtgtgagtagtcattggatacatacataasagtgagcaagtttatcagctcctgcatggcagtgttctgatgatcttttgctgcaaaagagctacaccccaaattagtggcttaaagtaaaagcttactagtgtatatgatgattctgttggtccaggatttggaaagggcatggcaggaggtctcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagaacacagaagcttttgcagtgttggtgctaaaatggttcycttgtcagaggagttacgttttatgagatcctctaagcaaatttagaaaaggagaggaacttgaccacagaaactgtgtttgatacatttgagcaacaaaactctttcagagacattttaaytcacgatgtgggaaarccaatgagagaagaaaaaagaaattctcatctgaaacttgaacttatcaaaactcacttgtctagaaattagcctgggawcatccaggcactggaatttctcactttttttccttctccctctcaacttcagtamtgaraggagaaagtcatttccaaatgyctatrttttgactttttaaatagaccaaatttagagtcatgtaaagatacaataattagctttcttaacaatttkcaccyagakgtattkttatagagaataaaaacaacaaca

SEQ ID NO: 4 - DNA, 1158 bp, Homo sapiens
  5'UTR 1..187
  CDS 188..520
  3'UTR 521..1158
  allele 1: 8-140-108  : polymorphic base G or C
  allele 66: 8-140-173  : polymorphic base G or T
  allele 179: 8-140-286  : polymorphic base C or T
  allele 326: 8-141-161  : polymorphic base A or C
  allele 425: 8-141-260  : polymorphic base A or G
  allele 469: 8-141-304  : polymorphic base A or G
  allele 577: 8-144-127  : deletion of GTATCCA
  allele 646: 8-144-196  : polymorphic base A or T
  allele 684: 8-144-234  : polymorphic base A or G
  allele 828: 8-144-378  : polymorphic base A or G
  allele 914: 99-16050-235  : polymorphic base G or C
  allele 1089: 8-135-112  : polymorphic base C or T
  allele 1143: 8-135-166  : polymorphic base A or C
stccacctgctggtagtgcactccttaggtgcctgtctctggctgtcctgtgccacctgcacagaktcatgcatgagctccactgtgggaagtctctagagatgagctgagcttaccctacaccaactgaaagagtctatctaagtcctgaagatcacaagtcatcctcatattcccaygaatgtgaatggaagttgggcctgctcagagaatcatcagggctctttattgtggcctggagccaactgccaaggagtgcctaggaacacactcagtaagagtgttgccctcaggccagatcagacttgaacctgcagagaaatccmctaggtatgtcagcaattgctcatttggatgctataaacttgaagttgtgaaaaatataaagacttacattatccagtctctcctggcaaaatatgtargtttaatcattcctgaattttccttagttcacacagatatacaratatatatcctaaaaattggcattggtaggcgtgtcaagttatcattttaaaaacatagaaacctgaacaagatgtatcactccagtctagaatgtctatatgcagagtatccacaaaaaaccaaacttcaacagtctttcatgtctatatttcttcaacattctttgtcttcaacwttctttcatgtctagaatgtctatatgcagagtatccrcaaaagacccaaacttctttcatttaaagaaccaaacttctttaaataaaaatgactcacaataatttaatattttaccatttacaaagagattaactacaacaatattgatcttgagttaatttcccacgaataacattttcrtttcttaaaatttgctgaatggaaagccagaaagtagagtgaagcaagtaatgtgtgtgtgagtagtcattggatacatacataasagtgagcaagtttatcagctcctgcatggcagtgttctgatgatcttttgctgcaaaagagctacaccccaaattagtggcttaaagtaaaagcttactagtgtatatgatgattctgttggtccaggatttggaaagggcatggcaggaggtctcatctctgcttcacaatgcygatgatttagctgggaggacccaaaatgctggaaaagctgatgggtgctgattmtctccagcttttcag

SEQ ID NO: 5 - DNA, 894 bp, Homo sapiens
  5'UTR 1..253
  CDS 254..304
  3'UTR 305..894
  polyA_signal 879..884
  allele 53: 99-16050-235  : polymorphic base G or C
  allele 228: 8-135-112  : polymorphic base C or T
  allele 282: 8-135-166  : polymorphic base A or C
  allele 388: 99-16038-118  : polymorphic base A or G
  allele 447: 8-137-152  : polymorphic base G or T
  allele 477: 8-137-182  : polymorphic base A or G
  allele 602: 8-138-218  : polymorphic base C or T
  allele 618: 8-138-234  : polymorphic base A or G
  allele 698: 8-119-38  : polymorphic base A or T
  allele 753: 8-119-93  : polymorphic base A or C
  allele 757: 8-119-97  : polymorphic base A or G
  allele 780: 8-119-120  : polymorphic base C or T
  allele 785: 8-119-125  : polymorphic base A or G
  allele 855: 8-119-195  : polymorphic base G or T
  allele 860: 8-119-200  : polymorphic base C or T
  allele 864: 8-119-204  : polymorphic base G or T
  allele 870: 8-119-210  : polymorphic base G or T
gtagagtgaagcaagtaatgtgtgtgtgagtagtcattggatacatacataasagtgagcaagtttatcagctcctgcatggcagtgttctgatgatcttttgctgcaaaagagctacaccccaaattagtggcttaaagtaaaagcttactagtgtatatgatgattctgttggtccaggatttggaaagggcatggcaggaggtctcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaactctttcagagacattttaaytcacgatgtgggaaarccaatgagagaagaaaaaagaaattctcatctgaaacttgaacttatcaaaactcacttgtctagaaattagcctgggawcatccaggcactggaatttctcactttttttccttctccctctcaacttcagtamtgaraggagaaagtcatttccaaatgyctatrttttgactttttaaatagaccaaatttagagtcatgtaaagatacaataattagctttcttaacaatttkcaccyagakgtattkttatagagaataaaaacaacaaca

SEQ ID NO: 6 - DNA, 863 bp, Homo sapiens
  5'UTR 1..25
  CDS 26..76
  3'UTR 77..863
  polyA_signal 839..844
  allele 54: 8-135-166  : polymorphic base A or C
  allele 160: 99-16038-118  : polymorphic base A or G
  allele 219: 8-137-152  : polymorphic base G or T
  allele 249: 8-137-182  : polymorphic base A or G
  allele 413: 8-143-232  : polymorphic base G or C
  allele 420: 8-143-239  : polymorphic base A or G
  allele 423: 8-143-242  : polymorphic base C or T
  allele 426: 8-143-245  : polymorphic base A or C
  allele 511: 8-130-220  : polymorphic base A or C
  allele 527: 8-130-236  : polymorphic base A or G
  allele 699: 8-131-199  : polymorphic base A or C
  allele 762: 8-132-97  : polymorphic base C or T
  allele 829: 8-132-164  : polymorphic base C or T
  allele 844: 8-132-179  : polymorphic base A or T
gatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagctcattttgtataaagcaggcctttatgtcagaagctgagacctccaacagatggaaatsaaaaccrtcytgmtaccagaccttggatctggaaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 7 - DNA, 603 bp, Homo sapiens
  CDS 2..310
  3'UTR 311..603
  polyA_signal 588..593
  allele 27: 8-135-166  : polymorphic base A or C
  allele 87: 99-16038-118  : polymorphic base A or G
  allele 146: 8-137-152  : polymorphic base G or T
  allele 176: 8-137-182  : polymorphic base A or G
  allele 289: 8-145-138  : polymorphic base G or T
  allele 311: 8-138-218  : polymorphic base C or T
  allele 327: 8-138-234  : polymorphic base A or G
  allele 407: 8-119-38  : polymorphic base A or T
  allele 462: 8-119-93  : polymorphic base A or C
  allele 466: 8-119-97  : polymorphic base A or G
  allele 489: 8-119-120  : polymorphic base C or T
  allele 494: 8-119-125  : polymorphic base A or G
  allele 564: 8-119-195  : polymorphic base G or T
  allele 569: 8-119-200  : polymorphic base C or T
  allele 573: 8-119-204  : polymorphic base G or T
  allele 579: 8-119-210  : polymorphic base G or T
gctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaacattccaakactctttcagagacattttaaytcacgatgtgggaaarccaatgagagaagaaaaaagaaattctcatctgaaacttgaacttatcaaaactcacttgtctagaaattagcctgggawcatccaggcactggaatttctcactttttttccttctccctctcaacttcagtamtgaraggagaaagtcatttccaaatgyctatrttttgactttttaaatagaccaaatttagagtcatgtaaagatacaataattagctttcttaacaatttkcaccyagakgtattkttatagagaataaaaacaacaaca

SEQ ID NO: 8 - DNA, 593 bp, Homo sapiens
  CDS 2..358
  3'UTR 359..593
  polyA_signal 578..583
  allele 27: 8-135-166  : polymorphic base A or C
  allele 87: 99-16038-118  : polymorphic base A or G
  allele 146: 8-137-152  : polymorphic base G or T
  allele 176: 8-137-182  : polymorphic base A or G
  allele 301: 8-138-218  : polymorphic base C or T
  allele 317: 8-138-234  : polymorphic base A or G
  allele 397: 8-119-38  : polymorphic base A or T
  allele 452: 8-119-93  : polymorphic base A or C
  allele 456: 8-119-97  : polymorphic base A or G
  allele 479: 8-119-120  : polymorphic base C or T
  allele 484: 8-119-125  : polymorphic base A or G
  allele 554: 8-119-195  : polymorphic base G or T
  allele 559: 8-119-200  : polymorphic base C or T
  allele 563: 8-119-204  : polymorphic base G or T
  allele 569: 8-119-210  : polymorphic base G or T
gctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaactctttcagagacattttaaytcacgatgtgggaaarccaatgagagaagaaaaaagaaattctcatctgaaacttgaacttatcaaaactcacttgtctagaaattagcctgggawcatccaggcactggaatttctcactttttttccttctccctctcaacttcagtamtgaraggagaaagtcatttccaaatgyctatrttttgactttttaaatagaccaaatttagagtcatgtaaagatacaataattagctttcttaacaatttkcaccyagakgtattkttatagagaataaaaacaacaaca

SEQ ID NO: 9 - DNA, 649 bp, Homo sapiens
  CDS 2..49
  3'UTR 50..649
  polyA_signal 634..639
  allele 27: 8-135-166  : polymorphic base A or C
  allele 133: 99-16038-118  : polymorphic base A or G
  allele 192: 8-137-152  : polymorphic base G or T
  allele 222: 8-137-182  : polymorphic base A or G
  allele 335: 8-145-138  : polymorphic base G or T
  allele 357: 8-138-218  : polymorphic base C or T
  allele 373: 8-138-234  : polymorphic base A or G
  allele 453: 8-119-38  : polymorphic base A or T
  allele 508: 8-119-93  : polymorphic base A or C
  allele 512: 8-119-97  : polymorphic base A or G
  allele 535: 8-119-120  : polymorphic base C or T
  allele 540: 8-119-125  : polymorphic base A or G
  allele 610: 8-119-195  : polymorphic base G or T
  allele 615: 8-119-200  : polymorphic base C or T
  allele 619: 8-119-204  : polymorphic base G or T
  allele 625: 8-119-210  : polymorphic base G or T
gctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaacattccaakactctttcagagacattttaaytcacgatgtgggaaarccaatgagagaagaaaaaagaaattctcatctgaaacttgaacttatcaaaactcacttgtctagaaattagcctgggawcatccaggcactggaatttctcactttttttccttctccctctcaacttcagtamtgaraggagaaagtcatttccaaatgyctatrttttgactttttaaatagaccaaatttagagtcatgtaaagatacaataattagctttcttaacaatttkcaccyagakgtattkttatagagaataaaaacaacaaca

SEQ ID NO: 10 - DNA, 733 bp, Homo sapiens
  CDS 2..49
  3'UTR 50..733
  polyA_signal 718..723
  allele 27: 8-135-166  : polymorphic base A or C
  allele 133: 99-16038-118  : polymorphic base A or G
  allele 192: 8-137-152  : polymorphic base G or T
  allele 222: 8-137-182  : polymorphic base A or G
  allele 336: 8-145-138  : polymorphic base G or T
  allele 352: 8-145-154  : polymorphic base A or G
  allele 395: 8-145-197  : polymorphic base A or G
  allele 441: 8-138-218  : polymorphic base C or T
  allele 457: 8-138-234  : polymorphic base A or G
  allele 537: 8-119-38  : polymorphic base A or T
  allele 592: 8-119-93  : polymorphic base A or C
  allele 596: 8-119-97  : polymorphic base A or G
  allele 619: 8-119-120  : polymorphic base C or T
  allele 624: 8-119-125  : polymorphic base A or G
  allele 694: 8-119-195  : polymorphic base G or T
  allele 699: 8-119-200  : polymorphic base C or T
  allele 703: 8-119-204  : polymorphic base G or T
  allele 709: 8-119-210  : polymorphic base G or T
gctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaacattccaagktgattctaaatggcartttgcactgtcattttaaaagaatttctcagatatttgctggrcactttatggaaggagacactgagactctttcagagacattttaaytcacgatgtgggaaarccaatgagagaagaaaaaagaaattctcatctgaaacttgaacttatcaaaactcacttgtctagaaattagcctgggawcatccaggcactggaatttctcactttttttccttctccctctcaacttcagtamtgaraggagaaagtcatttccaaatgyctatrttttgactttttaaatagaccaaatttagagtcatgtaaagatacaataattagctttcttaacaatttkcaccyagakgtattkttatagagaataaaaacaacaaca

SEQ ID NO: 11 - DNA, 1009 bp, Homo sapiens
  5'UTR 1..267
  CDS 268..318
  3'UTR 319..1009
  polyA_signal 985..990
  allele 136: 8-144-378  : polymorphic base A or G
  allele 242: 8-135-112  : polymorphic base C or T
  allele 296: 8-135-166  : polymorphic base A or C
  allele 402: 99-16038-118  : polymorphic base A or G
  allele 461: 8-137-152  : polymorphic base G or T
  allele 491: 8-137-182  : polymorphic base A or G
  allele 657: 8-130-220  : polymorphic base A or C
  allele 673: 8-130-236  : polymorphic base A or G
  allele 845: 8-131-199  : polymorphic base A or C
  allele 908: 8-132-97  : polymorphic base C or T
  allele 975: 8-132-164  : polymorphic base C or T
  allele 990: 8-132-179  : polymorphic base A or T
ccaaacttctttcatttaaagaaccaaacttctttaaataaaaatgactcacaataatttaatattttaccatttacaaagagattaactacaacaatattgatcttgagttaatttcccacgaataacattttcrtttcttaaaatttgctgaatggaaagccagaaagtagagtgaagcaagtaatgtgtgtgatttggaaagggcatggcaggaggtctcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 12 - DNA, 897 bp, Homo sapiens
  5'UTR 1..46
  CDS 47..97
  3'UTR 98..897
  polyA_signal 873..878
  allele 21: 8-135-112  : polymorphic base C or T
  allele 75: 8-135-166  : polymorphic base A or C
  allele 181: 99-16038-118  : polymorphic base A or G
  allele 240: 8-137-152  : polymorphic base G or T
  allele 270: 8-137-182  : polymorphic base A or G
  allele 408: 8-130-83  : polymorphic base G or T
  allele 426: 8-130-101  : polymorphic base A or C
  allele 427: 8-130-102  : polymorphic base A or G
  allele 468: 8-130-143  : polymorphic base C or T
  allele 469: 8-130-144  : polymorphic base A or G
  allele 545: 8-130-220  : polymorphic base A or C
  allele 561: 8-130-236  : polymorphic base A or G
  allele 733: 8-131-199  : polymorphic base A or C
  allele 796: 8-132-97  : polymorphic base C or T
  allele 863: 8-132-164  : polymorphic base C or T
  allele 878: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagagctgggacttctaaccaatggaacatgggaaakgtgatgacacttgactcmrgtgatgaggttacctttcacaagacctggccaactgagacyrgatctccttacaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 13 - DNA, 777 bp, Homo sapiens
  5'UTR 1..46
  CDS 47..343
  3'UTR 344..777
  polyA_signal 753..758
  allele 21: 8-135-112  : polymorphic base C or T
  allele 75: 8-135-166  : polymorphic base A or C
  allele 135: 99-16038-118  : polymorphic base A or G
  allele 194: 8-137-152  : polymorphic base G or T
  allele 224: 8-137-182  : polymorphic base A or G
  allele 362: 8-130-83  : polymorphic base G or T
  allele 425: 8-130-220  : polymorphic base A or C
  allele 441: 8-130-236  : polymorphic base A or G
  allele 613: 8-131-199  : polymorphic base A or C
  allele 676: 8-132-97  : polymorphic base C or T
  allele 743: 8-132-164  : polymorphic base C or T
  allele 758: 8-132-179  : polymorphic base A or T
tcatctctgcttcacaatgcygatgatttagctgggaggacccaaaatgctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagagctgggacttctaaccaatggaacatgggaaakgcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 14 - DNA, 823 bp, Homo sapiens
  5'UTR 1..46
  CDS 47..97
  3'UTR 98..823
  polyA_signal 799..804
  allele 21: 8-135-112  : polymorphic base C or T
  allele 75: 8-135-166  : polymorphic base A or C
  allele 181: 99-16038-118  : polymorphic base A or G
  allele 240: 8-137-152  : polymorphic base G or T
  allele 270: 8-137-182  : polymorphic base A or G
  allele 408: 8-130-83  : polymorphic base G or T
  allele 471: 8-130-220  : polymorphic base A or C
  allele 487: 8-130-236  : polymorphic base A or G
  allele 659: 8-131-199  : polymorphic base A or C
  allele 722: 8-132-97  : polymorphic base C or T
  allele 789: 8-132-164  : polymorphic base C or T
  allele 804: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagagctgggacttctaaccaatggaacatgggaaakgcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 15 - DNA, 836 bp, Homo sapiens
  5'UTR 1..46
  CDS 47..427
  3'UTR 428..836
  polyA_signal 812..817
  allele 21: 8-135-112  : polymorphic base C or T
  allele 75: 8-135-166  : polymorphic base A or C
  allele 135: 99-16038-118  : polymorphic base A or G
  allele 194: 8-137-152  : polymorphic base G or T
  allele 224: 8-137-182  : polymorphic base A or G
  allele 338: 8-145-138  : polymorphic base G or T
  allele 354: 8-145-154  : polymorphic base A or G
  allele 397: 8-145-197  : polymorphic base A or G
  allele 484: 8-130-220  : polymorphic base A or C
  allele 500: 8-130-236  : polymorphic base A or G
  allele 672: 8-131-199  : polymorphic base A or C
  allele 735: 8-132-97  : polymorphic base C or T
  allele 802: 8-132-164  : polymorphic base C or T
  allele 817: 8-132-179  : polymorphic base A or T
tcatctctgcttcacaatgcygatgatttagctgggaggacccaaaatgctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaacattccaagktgattctaaatggcartttgcactgtcattttaaaagaatttctcagatatttgctggrcactttatggaaggagacactgaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 16 - DNA, 882 bp, Homo sapiens
  5'UTR 1..46
  CDS 47..97
  3'UTR 98..882
  polyA_signal 858..863
  allele 21: 8-135-112  : polymorphic base C or T
  allele 75: 8-135-166  : polymorphic base A or C
  allele 181: 99-16038-118  : polymorphic base A or G
  allele 240: 8-137-152  : polymorphic base G or T
  allele 270: 8-137-182  : polymorphic base A or G
  allele 384: 8-145-138  : polymorphic base G or T
  allele 400: 8-145-154  : polymorphic base A or G
  allele 443: 8-145-197  : polymorphic base A or G
  allele 530: 8-130-220  : polymorphic base A or C
  allele 546: 8-130-236  : polymorphic base A or G
  allele 718: 8-131-199  : polymorphic base A or C
  allele 781: 8-132-97  : polymorphic base C or T
  allele 848: 8-132-164  : polymorphic base C or T
  allele 863: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaacattccaagktgattctaaatggcartttgcactgtcattttaaaagaatttctcagatatttgctggrcactttatggaaggagacactgaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 17 - DNA, 955 bp, Homo sapiens
  5'UTR 1..46
  CDS 47..235
  3'UTR 236..955
  polyA_signal 931..936
  allele 21: 8-135-112  : polymorphic base C or T
  allele 75: 8-135-166  : polymorphic base A or C
  allele 135: 99-16038-118  : polymorphic base A or G
  allele 217: 8-137-152  : polymorphic base G or T
  allele 247: 8-137-182  : polymorphic base A or G
  allele 361: 8-145-138  : polymorphic base G or T
  allele 377: 8-145-154  : polymorphic base A or G
  allele 420: 8-145-197  : polymorphic base A or G
  allele 505: 8-143-232  : polymorphic base G or C
  allele 512: 8-143-239  : polymorphic base A or G
  allele 515: 8-143-242  : polymorphic base C or T
  allele 518: 8-143-245  : polymorphic base A or C
  allele 603: 8-130-220  : polymorphic base A or C
  allele 619: 8-130-236  : polymorphic base A or G
  allele 791: 8-131-199  : polymorphic base A or C
  allele 854: 8-132-97  : polymorphic base C or T
  allele 921: 8-132-164  : polymorphic base C or T
  allele 936: 8-132-179  : polymorphic base A or T
tcatctctgcttcacaatgcygatgatttagctgggaggacccaaaatgctggaaaagctgatgggtgctgattmtctccagcttttcagatccagatatacattgggtaaaatctacttcataggttttcaaargagcattcttctgagcaaatctgaaaactctctaaactctattggtattcaccaaatccacaaaaatcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaacattccaagktgattctaaatggcartttgcactgtcattttaaaagaatttctcagatatttgctggrcactttatggaaggagacactgaggctcattttgtataaagcaggcctttatgtcagaagctgagacctccaacagatggaaatsaaaaccrtcytgmtaccagaccttggatctggaaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 18 - DNA, 851 bp, Homo sapiens
  5'UTR 1..46
  CDS 47..343
  3'UTR 344..851
  polyA_signal 827..832
  allele 21: 8-135-112  : polymorphic base C or T
  allele 75: 8-135-166  : polymorphic base A or C
  allele 135: 99-16038-118  : polymorphic base A or G
  allele 194: 8-137-152  : polymorphic base G or T
  allele 224: 8-137-182  : polymorphic base A or G
  allele 362: 8-130-83  : polymorphic base G or T
  allele 380: 8-130-101  : polymorphic base A or C
  allele 381: 8-130-102  : polymorphic base A or G
  allele 422: 8-130-143  : polymorphic base C or T
  allele 423: 8-130-144  : polymorphic base A or G
  allele 499: 8-130-220  : polymorphic base A or C
  allele 515: 8-130-236  : polymorphic base A or G
  allele 687: 8-131-199  : polymorphic base A or C
  allele 750: 8-132-97  : polymorphic base C or T
  allele 817: 8-132-164  : polymorphic base C or T
  allele 832: 8-132-179  : polymorphic base A or T
tcatctctgcttcacaatgcygatgatttagctgggaggacccaaaatgctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagagctgggacttctaaccaatggaacatgggaaakgtgatgacacttgactcmrgtgatgaggttacctttcacaagacctggccaactgagacyrgatctccttacaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 19 - DNA, 742 bp, Homo sapiens
  5'UTR 1..46
  CDS 47..508
  3'UTR 509..742
  polyA_signal 718..723
  allele 21: 8-135-112  : polymorphic base C or T
  allele 75: 8-135-166  : polymorphic base A or C
  allele 135: 99-16038-118  : polymorphic base A or G
  allele 194: 8-137-152  : polymorphic base G or T
  allele 224: 8-137-182  : polymorphic base A or G
  allele 390: 8-130-220  : polymorphic base A or C
  allele 406: 8-130-236  : polymorphic base A or G
  allele 578: 8-131-199  : polymorphic base A or C
  allele 641: 8-132-97  : polymorphic base C or T
  allele 708: 8-132-164  : polymorphic base C or T
  allele 723: 8-132-179  : polymorphic base A or T
tcatctctgcttcacaatgcygatgatttagctgggaggacccaaaatgctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 20 - DNA, 920 bp, Homo sapiens
  5'UTR 1..46
  CDS 47..97
  3'UTR 98..920
  polyA_signal 896..901
  allele 21: 8-135-112  : polymorphic base C or T
  allele 75: 8-135-166  : polymorphic base A or C
  allele 181: 99-16038-118  : polymorphic base A or G
  allele 263: 8-137-152  : polymorphic base G or T
  allele 293: 8-137-182  : polymorphic base A or G
  allele 431: 8-130-83  : polymorphic base G or T
  allele 449: 8-130-101  : polymorphic base A or C
  allele 450: 8-130-102  : polymorphic base A or G
  allele 491: 8-130-143  : polymorphic base C or T
  allele 492: 8-130-144  : polymorphic base A or G
  allele 568: 8-130-220  : polymorphic base A or C
  allele 584: 8-130-236  : polymorphic base A or G
  allele 756: 8-131-199  : polymorphic base A or C
  allele 819: 8-132-97  : polymorphic base C or T
  allele 886: 8-132-164  : polymorphic base C or T
  allele 901: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattggtattcaccaaatccacaaaaatcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagagctgggacttctaaccaatggaacatgggaaakgtgatgacacttgactcmrgtgatgaggttacctttcacaagacctggccaactgagacyrgatctccttacaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 21 - DNA, 811 bp, Homo sapiens
  5'UTR 1..46
  CDS 47..97
  3'UTR 98..811
  polyA_signal 787..792
  allele 21: 8-135-112  : polymorphic base C or T
  allele 75: 8-135-166  : polymorphic base A or C
  allele 181: 99-16038-118  : polymorphic base A or G
  allele 263: 8-137-152  : polymorphic base G or T
  allele 293: 8-137-182  : polymorphic base A or G
  allele 459: 8-130-220  : polymorphic base A or C
  allele 475: 8-130-236  : polymorphic base A or G
  allele 647: 8-131-199  : polymorphic base A or C
  allele 710: 8-132-97  : polymorphic base C or T
  allele 777: 8-132-164  : polymorphic base C or T
  allele 792: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattggtattcaccaaatccacaaaaatcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 22 - DNA, 978 bp, Homo sapiens
  5'UTR 1..46
  CDS 47..97
  3'UTR 98..978
  polyA_signal 954..959
  allele 21: 8-135-112  : polymorphic base C or T
  allele 75: 8-135-166  : polymorphic base A or C
  allele 181: 99-16038-118  : polymorphic base A or G
  allele 240: 8-137-152  : polymorphic base G or T
  allele 270: 8-137-182  : polymorphic base A or G
  allele 384: 8-145-138  : polymorphic base G or T
  allele 400: 8-145-154  : polymorphic base A or G
  allele 443: 8-145-197  : polymorphic base A or G
  allele 528: 8-143-232  : polymorphic base G or C
  allele 535: 8-143-239  : polymorphic base A or G
  allele 538: 8-143-242  : polymorphic base C or T
  allele 541: 8-143-245  : polymorphic base A or C
  allele 626: 8-130-220  : polymorphic base A or C
  allele 642: 8-130-236  : polymorphic base A or G
  allele 814: 8-131-199  : polymorphic base A or C
  allele 877: 8-132-97  : polymorphic base C or T
  allele 944: 8-132-164  : polymorphic base C or T
  allele 959: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagaacattccaagktgattctaaatggcartttgcactgtcattttaaaagaatttctcagatatttgctggrcactttatggaaggagacactgaggctcattttgtataaagcaggcctttatgtcagaagctgagacctccaacagatggaaatsaaaaccrtcytgmtaccagaccttggatctggaaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 23 - DNA, 993 bp, Homo sapiens
  5'UTR 1..46
  CDS 47..97
  3'UTR 98..993
  polyA_signal 969..974
  allele 21: 8-135-112  : polymorphic base C or T
  allele 75: 8-135-166  : polymorphic base A or C
  allele 181: 99-16038-118  : polymorphic base A or G
  allele 240: 8-137-152  : polymorphic base G or T
  allele 270: 8-137-182  : polymorphic base A or G
  allele 434: 8-143-232  : polymorphic base G or C
  allele 441: 8-143-239  : polymorphic base A or G
  allele 444: 8-143-242  : polymorphic base C or T
  allele 447: 8-143-245  : polymorphic base A or C
  allele 504: 8-130-83  : polymorphic base G or T
  allele 522: 8-130-101  : polymorphic base A or C
  allele 523: 8-130-102  : polymorphic base A or G
  allele 564: 8-130-143  : polymorphic base C or T
  allele 565: 8-130-144  : polymorphic base A or G
  allele 641: 8-130-220  : polymorphic base A or C
  allele 657: 8-130-236  : polymorphic base A or G
  allele 829: 8-131-199  : polymorphic base A or C
  allele 892: 8-132-97  : polymorphic base C or T
  allele 959: 8-132-164  : polymorphic base C or T
  allele 974: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagctcattttgtataaagcaggcctttatgtcagaagctgagacctccaacagatggaaatsaaaaccrtcytgmtaccagaccttggatctggaaggagctgggacttctaaccaatggaacatgggaaakgtgatgacacttgactcmrgtgatgaggttacctttcacaagacctggccaactgagacyrgatctccttacaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 24 - DNA, 822 bp, Homo sapiens
  5'UTR 1..46
  CDS 47..97
  3'UTR 98..822
  polyA_signal 798..803
  allele 21: 8-135-112  : polymorphic base C or T
  allele 75: 8-135-166  : polymorphic base A or C
  allele 181: 99-16038-118  : polymorphic base A or G
  allele 240: 8-137-152  : polymorphic base G or T
  allele 270: 8-137-182  : polymorphic base A or G
  allele 436: 8-130-220  : polymorphic base A or C
  allele 452: 8-130-236  : polymorphic base A or G
  allele 624: 8-131-199  : polymorphic base A or C
  allele 721: 8-132-97  : polymorphic base C or T
  allele 788: 8-132-164  : polymorphic base C or T
  allele 803: 8-132-179  : polymorphic base A or T
tcatctctgcttcacaatgcygatgatttagctgggaggacccaaaatgctggaaaagctgatgggtgctgattmtctccagcttttcagggtataaaggaatctgaacacgactgatattttctttaatttttagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtgttttcttattattgttttgtttccttgtttttaggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 25 - DNA, 776 bp, Homo sapiens
  5'UTR 1..46
  CDS 47..508
  3'UTR 509..776
  polyA_signal 752..757
  allele 21: 8-135-112  : polymorphic base C or T
  allele 75: 8-135-166  : polymorphic base A or C
  allele 135: 99-16038-118  : polymorphic base A or G
  allele 194: 8-137-152  : polymorphic base G or T
  allele 224: 8-137-182  : polymorphic base A or G
  allele 390: 8-130-220  : polymorphic base A or C
  allele 406: 8-130-236  : polymorphic base A or G
  allele 578: 8-131-199  : polymorphic base A or C
  allele 675: 8-132-97  : polymorphic base C or T
  allele 742: 8-132-164  : polymorphic base C or T
  allele 757: 8-132-179  : polymorphic base A or T
tcatctctgcttcacaatgcygatgatttagctgggaggacccaaaatgctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtgttttcttattattgttttgtttccttgtttttaggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 26 - DNA, 947 bp, Homo sapiens
  5'UTR 1..46
  CDS 47..367
  3'UTR 368..947
  polyA_signal 923..928
  allele 21: 8-135-112  : polymorphic base C or T
  allele 75: 8-135-166  : polymorphic base A or C
  allele 135: 99-16038-118  : polymorphic base A or G
  allele 194: 8-137-152  : polymorphic base G or T
  allele 224: 8-137-182  : polymorphic base A or G
  allele 388: 8-143-232  : polymorphic base G or C
  allele 395: 8-143-239  : polymorphic base A or G
  allele 398: 8-143-242  : polymorphic base C or T
  allele 401: 8-143-245  : polymorphic base A or C
  allele 458: 8-130-83  : polymorphic base G or T
  allele 476: 8-130-101  : polymorphic base A or C
  allele 477: 8-130-102  : polymorphic base A or G
  allele 518: 8-130-143  : polymorphic base C or T
  allele 519: 8-130-144  : polymorphic base A or G
  allele 595: 8-130-220  : polymorphic base A or C
  allele 611: 8-130-236  : polymorphic base A or G
  allele 783: 8-131-199  : polymorphic base A or C
  allele 846: 8-132-97  : polymorphic base C or T
  allele 913: 8-132-164  : polymorphic base C or T
  allele 928: 8-132-179  : polymorphic base A or T
tcatctctgcttcacaatgcygatgatttagctgggaggacccaaaatgctggaaaagctgatgggtgctgattmtctccagcttttcagatccagatatacattgggtaaaatctacttcataggttttcaaargagcattcttctgagcaaatctgaaaactctctaaactctattgcaaaggagacagaakaaggaagagagacggtaacaaggaaagaargatggaagagaaggcatgaggacggctatttggaaatggcacagaggcatttacagagatcattatgtccttgggtctcttaccttcctcagccctatgcagagctcattttgtataaagcaggcctttatgtcagaagctgagacctccaacagatggaaatsaaaaccrtcytgmtaccagaccttggatctggaaggagctgggacttctaaccaatggaacatgggaaakgtgatgacacttgactcmrgtgatgaggttacctttcacaagacctggccaactgagacyrgatctccttacaggcttgaagaagtaagcagccatgttggaaaagtcttcatggcaagaaactatgagttccttgmctatgaggcctctaargaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggamtctgacggactctgtgtctgggacccagctgataacacgtggtgatgggattgtatttgcaaytctctggtcagtaagtgataaaatgccatttctatgcacccacctggcctgtgtgactgggagaatytctctttttattaawtgtgcttcaagttttaaca

SEQ ID NO: 27 - protein, 16 aa, Homo sapiens
  VARIANT 10: Xaa=Ser or Tyr
MLEKLMGADXLQLFRV

SEQ ID NO: 28 - protein, 110 aa, Homo sapiens
  VARIANT 47: Xaa=Pro or Thr
  VARIANT 80: Xaa=Gly or Ser
MEVGPAQRIIRALYCGLEPTAKECLGTHSVRVLPSGQIRLEPAEKSXRYVSNCSFGCYKLEVVKNIKTYIIQSLLAKYVXLIIPEFSLVHTDIQIYILKIGIGRRVKLSF

SEQ ID NO: 29 - protein, 102 aa, Homo sapiens
  VARIANT 9: Xaa=Ser or Tyr
  VARIANT 29: Xaa=Lys or Arg
  VARIANT 49: Xaa=Glu or Stop
  VARIANT 59: Xaa=Gly or Arg
  VARIANT 96: Xaa=Lys or Asn
  SITE 62..63: basic protease cleavage site
  PEPTIDE 1..63
  PEPTIDE 64..102
LEKLMGADXLQLFRSRYTLGKIYFIGFQXSILLSKSENSLNSIAKETEXGRETVTRKEXWKRRHEDGYLEMAQRHLQRSLCPWVSYLPQPYAEHSXTLSETF

SEQ ID NO: 30 - protein, 118 aa, Homo sapiens
  VARIANT 9: Xaa=Ser or Tyr
  VARIANT 29: Xaa=Lys or Arg
  VARIANT 49: Xaa=Glu or Stop
  VARIANT 59: Xaa=Gly or Arg
  VARIANT 106: Xaa=Thr or Ala
  SITE 63..64: basic protease cleavage site
  SITE 110..111: basic protease cleavage site
  DISULFID 82..104
  PEPTIDE 1..64
  PEPTIDE 65..111
  PEPTIDE 112..119
LEKLMGADXLQLFRSRYTLGKIYFIGFQXSILLSKSENSLNSIAKETEXGRETVTRKEXWKRRHEDGYLEMAQRHLQRSLCPWVSYLPQPYAELFQRHFNSRCGKXNERRKKKFSSET

SEQ ID NO: 31 - protein, 98 aa, Homo sapiens
  VARIANT 10: Xaa=Ser or Tyr
  VARIANT 30: Xaa=Lys or Arg
  VARIANT 50: Xaa=Glu or Stop
  VARIANT 60: Xaa=Gly or Arg
MLEKLMGADXLQLFRSRYTLGKIYFIGFQXSILLSKSENSLNSIAKETEXGRETVTRKEXWKRRHEDGYLEMAQRHLQRSLCPWVSYLPQPYAESWDF

SEQ ID NO: 32 - protein, 126 aa, Homo sapiens
  VARIANT 10: Xaa=Ser or Tyr
  VARIANT 30: Xaa=Lys or Arg
  VARIANT 50: Xaa=Glu or Stop
  VARIANT 60: Xaa=Gly or Arg
  VARIANT 98: Xaa=Val or Leu
  VARIANT 103: Xaa=Asn or Ser
  SITE 63..64: basic protease cleavage site
  DISULFID 82..106
  PEPTIDE 1..64
  PEPTIDE 65..126
MLEKLMGADXLQLFRSRYTLGKIYFIGFQXSILLSKSENSLNSIAKETEXGRETVTRKEXWKRRHEDGYLEMAQRHLQRSLCPWVSYLPQPYAEHSKXILNGXLHCHFKRISQIFAGHFMEGDTEA

SEQ ID NO: 33 - protein, 62 aa, Homo sapiens
  VARIANT 10: Xaa=Ser or Tyr
  VARIANT 30: Xaa=Lys or Arg
  VARIANT 57: Xaa=Lys or Asn
  SITE 54..55: basic protease cleavage site
  SITE 57..58: basic protease cleavage site
  PEPTIDE 1..53
  PEPTIDE 58..61
MLEKLMGADXLQLFRSRYTLGKIYFIGFQXSILLSKSENSLNSIGIHQIHKNQRRQXKEERR

SEQ ID NO: 34 - protein, 153 aa, Homo sapiens
  VARIANT 10: Xaa=Ser or Tyr
  VARIANT 30: Xaa=Lys or Arg
  VARIANT 50: Xaa=Glu or Stop
  VARIANT 60: Xaa=Gly or Arg
  VARIANT 115: Xaa=Ala or Asp
  SITE 63..64: basic protease cleavage site
  SITE 122..123: basic protease cleavage site
  DISULFID 132..142
  PEPTIDE 1..64
  PEPTIDE 65..123
  PEPTIDE 124..153
MLEKLMGADXLQLFRSRYTLGKIYFIGFQXSILLSKSENSLNSIAKETEXGRETVTRKEXWKRRHEDGYLEMAQRHLQRSLCPWVSYLPQPYAELEEVSSHVGKVFMARNYEFLXYEASKDRRQPLERMWTCNYNQQKDQSCNHKEITSTKAE

SEQ ID NO: 35 - protein, 106 aa, Homo sapiens
  VARIANT 10: Xaa=Ser or Tyr
  VARIANT 30: Xaa=Lys or Arg
  VARIANT 50: Xaa=Glu or Stop
  VARIANT 60: Xaa=Gly or Arg
  SITE 62..63: basic protease cleavage site
  SITE 63..64: basic protease cleavage site
  PEPTIDE 1..61
  PEPTIDE 65..106
MLEKLMGADXLQLFRSRYTLGKIYFIGFQXSILLSKSENSLNSIAKETEXGRETVTRKEXWKRRHEDGYLEMAQRHLQRSLCPWVSYLPQPYAELILYKAGLYVRS

SEQ ID NO: 36 - DNA, 1301 bp, Homo sapiens
  5'UTR 1..899
  CDS 900..1265
  3'UTR 1266..1301
  polyA_signal 1277..1282
  allele 191: 8-121-187  : polymorphic base A or C
  allele 313: 8-122-271  : deletion of CAAA
  allele 314: 8-122-272  : polymorphic base A or G
  allele 368: 8-122-326  : polymorphic base A or C
  allele 390: 8-123-55  : polymorphic base A or T
  allele 806: 8-127-28  : polymorphic base A or G
  allele 897: 8-127-119  : polymorphic base A or G
  allele 937: 8-127-159  : polymorphic base A or C
  allele 961: 8-128-61  : polymorphic base G or C
  allele 968: 8-128-68  : polymorphic base C or T
  allele 969: 8-128-69  : polymorphic base A or G
  allele 985: 8-128-85  : polymorphic base A or C
  allele 1044: 8-129-50  : polymorphic base C or T
  allele 1055: 8-129-60  : deletion of A
gtcattattacaatgaagggaagaaaggaagacatgaaggggaaatgggactatttaccaagtgtatctgcatagactaaaggagacaagaggaagtactgagcaccttgattcctgcagataattatttaagaaccataagaattctttcctagcttctcataagcctgctccttcaaagggttaactgmagtgaatcaaactattggattataattccatgaagtaagtttattgaagacaaacaggccttgggccgctgcctctgtctctcctgccttccccactgaatctccagcccacattcacaaacraagacaaacctgtgtaaactgaagcaccacaaaactacttttatgaaagcagamtggaagcagatttcacctgcawttcctacattcaactgaatcctttaaattgactgaggcacatcctgtaccaaggagagacctttgttactgcctttgatcctgagaccttctgagccaggaaccctgcttttaagaggaaggtcttggccaggctcagtggctcacacctgtaatcccagcactttgggaggccgaggcgggcagatcacctgaggtcaggagttcaagaccagcctgaccaatatggtgaaaccccatctctactaaaaatacaaaaattagccaggcatggtggcaggtgcctgtagtcccagctactcgggaggctgagacaggagaattgcttgaacctgggaggcggaggttgcagtgagccaagatcacaccactgcactccagcctgggcaacagagtgagactccatctcaaattaaraaaaaaaataagatacagaatataaagagacagcataaatgatagaaaacaaaataagcatgttcatgagccagaaatcaagaagaaaagrcaatgataaaaagggctgaagccggaggcatcccaggccmtgggtctggaagcagctctggagsctgctgyrttccttggctcttggmtgcctctccatcttcaaagtgcatcactgcagcctgcgcttcatccatcacgttggctytgtcgctcacatttctacttctctcttgcaaggacccttgggattctattggactcacctggataatccaagataatcttcatcttaaaatccttaatttagtcacacacagaaaatcacctctgttatgtaaagtaacatatttccatatcctggaggaagggggcattgatgtgtctaccacagcatccacaaagggaacaaaaaatattgtccaataaatgcatatagaaataaatttgtggattcaggaaaaa

SEQ ID NO: 37 - DNA, 1154 bp, Homo sapiens
  5'UTR 1..719
  CDS 720..1118
  3'UTR 1119..1154
  polyA_signal 1131..1136
  allele 191: 8-121-187  : polymorphic base A or C
  allele 313: 8-122-271  : deletion of CAAA
  allele 314: 8-122-272  : polymorphic base A or G
  allele 368: 8-122-326  : polymorphic base A or C
  allele 390: 8-123-55  : polymorphic base A or T
  allele 814: 8-128-61  : polymorphic base G or C
  allele 821: 8-128-68  : polymorphic base C or T
  allele 822: 8-128-69  : polymorphic base A or G
  allele 838: 8-128-85  : polymorphic base A or C
  allele 897: 8-129-50  : polymorphic base C or T
  allele 908: 8-129-60  : deletion of A
gtcattattacaatgaagggaagaaaggaagacatgaaggggaaatgggactatttaccaagtgtatctgcatagactaaaggagacaagaggaagtactgagcaccttgattcctgcagataattatttaagaaccataagaattctttcctagcttctcataagcctgctccttcaaagggttaactgmagtgaatcaaactattggattataattccatgaagtaagtttattgaagacaaacaggccttgggccgctgcctctgtctctcctgccttccccactgaatctccagcccacattcacaaacraagacaaacctgtgtaaactgaagcaccacaaaactacttttatgaaagcagamtggaagcagatttcacctgcawttcctacattcaactgaatcctttaaattgactgaggcacatcctgtaccaaggagagacctttgttactgcctttgatcctgagaccttctgagccaggaaccctgcttttaagaggaaggtcttggccaggctcagtggctcacacctgtaatcccagcactttgggaggccgaggcgggcagatcacctgaggtcaggagttcaagaccagcctgaccaatatggtgaaaccccatctctactaaaaatacaaaaattagccaggcatggtggcaggtgcctgtagtcccagctactcgggaggctgagacaggagaattgcttgaacctgggaggcggaggttgcagtgagccaagatcacaccactgcactccagcctgggcaacagagtgagactccatctcaaattaactctggagsctgctgyrttccttggctcttggmtgcctctccatcttcaaagtgcatcactgcagcctgcgcttcatccatcacgttggctytgtcgctcacatttctacttctctcttgcaaggacccttgggattctattggactcacctggataatccaagataatcttcatcttaaaatccttaatttagtcacacacagaaaatcacctctgttatgtaaagtaacatatttccatatcctggaggaagggggcattgatgtgtctaccacagcatccacaaagggaacaaaaaatattgtccaataaatgcatatagaaataaatttgtggattcaggaaaaa

SEQ ID NO: 38 - DNA, 838 bp, Homo sapiens
  5'UTR 1..484
  CDS 485..802
  3'UTR 803..838
  polyA_signal 814..819
  allele 191: 8-121-187  : polymorphic base A or C
  allele 313: 8-122-271  : deletion of CAAA
  allele 314: 8-122-272  : polymorphic base A or G
  allele 368: 8-122-326  : polymorphic base A or C
  allele 390: 8-123-55  : polymorphic base A or T
  allele 498: 8-128-61  : polymorphic base G or C
  allele 505: 8-128-68  : polymorphic base C or T
  allele 506: 8-128-69  : polymorphic base A or G
  allele 522: 8-128-85  : polymorphic base A or C
  allele 581: 8-129-50  : polymorphic base C or T
  allele 592: 8-129-60  : deletion of A
gtcattattacaatgaagggaagaaaggaagacatgaaggggaaatgggactatttaccaagtgtatctgcatagactaaaggagacaagaggaagtactgagcaccttgattcctgcagataattatttaagaaccataagaattctttcctagcttctcataagcctgctccttcaaagggttaactgmagtgaatcaaactattggattataattccatgaagtaagtttattgaagacaaacaggccttgggccgctgcctctgtctctcctgccttccccactgaatctccagcccacattcacaaacraagacaaacctgtgtaaactgaagcaccacaaaactacttttatgaaagcagamtggaagcagatttcacctgcawttcctacattcaactgaatcctttaaattgactgaggcacatcctgtaccaaggagagacctttgttactgcctttgatcctgagaccttctgagccagctctggagsctgctgyrttccttggctcttggmtgcctctccatcttcaaagtgcatcactgcagcctgcgcttcatccatcacgttggctytgtcgctcacatttctacttctctcttgcaaggacccttgggattctattggactcacctggataatccaagataatcttcatcttaaaatccttaatttagtcacacacagaaaatcacctctgttatgtaaagtaacatatttccatatcctggaggaagggggcattgatgtgtctaccacagcatccacaaagggaacaaaaaatattgtccaataaatgcatatagaaataaatttgtggattcaggaaaaa

SEQ ID NO: 39 - DNA, 985 bp, Homo sapiens
  5'UTR 1..583
  CDS 584..949
  3'UTR 950..985
  polyA_signal 961..966
  allele 191: 8-121-187  : polymorphic base A or C
  allele 313: 8-122-271  : deletion of CAAA
  allele 314: 8-122-272  : polymorphic base A or G
  allele 368: 8-122-326  : polymorphic base A or C
  allele 390: 8-123-55  : polymorphic base A or T
  allele 490: 8-127-28  : polymorphic base A or G
  allele 581: 8-127-119  : polymorphic base A or G
  allele 621: 8-127-159  : polymorphic base A or C
  allele 645: 8-128-61  : polymorphic base G or C
  allele 652: 8-128-68  : polymorphic base C or T
  allele 653: 8-128-69  : polymorphic base A or G
  allele 669: 8-128-85  : polymorphic base A or C
  allele 728: 8-129-50  : polymorphic base C or T
  allele 739: 8-129-60  : deletion of A
gtcattattacaatgaagggaagaaaggaagacatgaaggggaaatgggactatttaccaagtgtatctgcatagactaaaggagacaagaggaagtactgagcaccttgattcctgcagataattatttaagaaccataagaattctttcctagcttctcataagcctgctccttcaaagggttaactgmagtgaatcaaactattggattataattccatgaagtaagtttattgaagacaaacaggccttgggccgctgcctctgtctctcctgccttccccactgaatctccagcccacattcacaaacraagacaaacctgtgtaaactgaagcaccacaaaactacttttatgaaagcagamtggaagcagatttcacctgcawttcctacattcaactgaatcctttaaattgactgaggcacatcctgtaccaaggagagacctttgttactgcctttgatcctgagaccttctgagccagraaaaaaaataagatacagaatataaagagacagcataaatgatagaaaacaaaataagcatgttcatgagccagaaatcaagaagaaaagrcaatgataaaaagggctgaagccggaggcatcccaggccmtgggtctggaagcagctctggagsctgctgyrttccttggctcttggmtgcctctccatcttcaaagtgcatcactgcagcctgcgcttcatccatcacgttggctytgtcgctcacatttctacttctctcttgcaaggacccttgggattctattggactcacctggataatccaagataatcttcatcttaaaatccttaatttagtcacacacagaaaatcacctctgttatgtaaagtaacatatttccatatcctggaggaagggggcattgatgtgtctaccacagcatccacaaagggaacaaaaaatattgtccaataaatgcatatagaaataaatttgtggattcaggaaaaa

SEQ ID NO: 40 - DNA, 1386 bp, Homo sapiens
  5'UTR 1..984
  CDS 985..1350
  3'UTR 1351..1386
  polyA_signal 1362..1367
  allele 191: 8-121-187  : polymorphic base A or C
  allele 398: 8-122-271  : deletion of CAAA
  allele 399: 8-122-272  : polymorphic base A or G
  allele 453: 8-122-326  : polymorphic base A or C
  allele 475: 8-123-55  : polymorphic base A or T
  allele 891: 8-127-28  : polymorphic base A or G
  allele 982: 8-127-119  : polymorphic base A or G
  allele 1022: 8-127-159  : polymorphic base A or C
  allele 1046: 8-128-61  : polymorphic base G or C
  allele 1053: 8-128-68  : polymorphic base C or T
  allele 1054: 8-128-69  : polymorphic base A or G
  allele 1070: 8-128-85  : polymorphic base A or C
  allele 1129: 8-129-50  : polymorphic base C or T
  allele 1140: 8-129-60  : deletion of A
gtcattattacaatgaagggaagaaaggaagacatgaaggggaaatgggactatttaccaagtgtatctgcatagactaaaggagacaagaggaagtactgagcaccttgattcctgcagataattatttaagaaccataagaattctttcctagcttctcataagcctgctccttcaaagggttaactgmagtgaatcaaactattggattataattccatgaagatctgccctttcatgtagtctgggcaccagagcaccctgagcccagtggactgcaccagtggactcttccatcctcagggttttgtaagtttattgaagacaaacaggccttgggccgctgcctctgtctctcctgccttccccactgaatctccagcccacattcacaaacraagacaaacctgtgtaaactgaagcaccacaaaactacttttatgaaagcagamtggaagcagatttcacctgcawttcctacattcaactgaatcctttaaattgactgaggcacatcctgtaccaaggagagacctttgttactgcctttgatcctgagaccttctgagccaggaaccctgcttttaagaggaaggtcttggccaggctcagtggctcacacctgtaatcccagcactttgggaggccgaggcgggcagatcacctgaggtcaggagttcaagaccagcctgaccaatatggtgaaaccccatctctactaaaaatacaaaaattagccaggcatggtggcaggtgcctgtagtcccagctactcgggaggctgagacaggagaattgcttgaacctgggaggcggaggttgcagtgagccaagatcacaccactgcactccagcctgggcaacagagtgagactccatctcaaattaaraaaaaaaataagatacagaatataaagagacagcataaatgatagaaaacaaaataagcatgttcatgagccagaaatcaagaagaaaagrcaatgataaaaagggctgaagccggaggcatcccaggccmtgggtctggaagcagctctggagsctgctgyrttccttggctcttggmtgcctctccatcttcaaagtgcatcactgcagcctgcgcttcatccatcacgttggctytgtcgctcacatttctacttctctcttgcaaggacccttgggattctattggactcacctggataatccaagataatcttcatcttaaaatccttaatttagtcacacacagaaaatcacctctgttatgtaaagtaacatatttccatatcctggaggaagggggcattgatgtgtctaccacagcatccacaaagggaacaaaaaatattgtccaataaatgcatatagaaataaatttgtggattcaggaaaaa

SEQ ID NO: 41 - protein, 121 aa, Homo sapiens
  SITE 86..87: basic protease cleavage site
  PEPTIDE 1..85
  PEPTIDE 88..121
MIKRAEAGGIPGPGSGSSSGGCCVPWLLAASPSSKCITAACASSITLALSLTFLLLSCKDPWDSIGLTWIIQDNLHLKILNLVTHRKSPLLCKVTYFHILEEGGIDVSTTASTKGTKNIVQ

SEQ ID NO: 42 - protein, 132 aa, Homo sapiens
  SITE 97..98: basic protease cleavage site
  PEPTIDE 1..96
  PEPTIDE 99..132
TWEAEVAVSQDHTTALQPGQQSETPSQINSGGCCVPWLLAASPSSKCITAACASSITLALSLTFLLLSCKDPWDSIGLTWIIQDNLHLKILNLVTHRKSPLLCKVTYFHILEEGGIDVSTTASTKGTKNIVQ

SEQ ID NO: 43 - protein, 105 aa, Homo sapiens
  SITE 70..71: basic protease cleavage site
  PEPTIDE 1..69
  PEPTIDE 72..105
ASSGGCCVPWLLAASPSSKCITAACASSITLALSLTFLLLSCKDPWDSIGLTWIIQDNLHLKILNLVTHRKSPLLCKVTYFHILEEGGIDVSTTASTKGTKNIVQ

SEQ ID NO: 44 - DNA, 35 bp, Artificial Sequence
  oligonucleotide g34872MbisEco
cccgaattcccaaacttctttcatttaaagaacca

SEQ ID NO: 45 - DNA, 36 bp, Artificial Sequence
  oligonucleotide g34872LR1309nBAmH1
atgcgggatccagagattctcccagtcacacaggcc

SEQ ID NO: 46 - DNA, 44 bp, Artificial Sequence
  oligonucleotide g34872genoLF22nEcoRI
tactggaattccaggtagagtgaagcaagtaatgtgtgtgtgag

SEQ ID NO: 47 - DNA, 35 bp, Artificial Sequence
  oligonucleotide g34872LR1309nBAmH1
atgcgggatccagagattctcccagtcacacaggc

SEQ ID NO: 48 - DNA, 33 bp, Artificial Sequence
  oligonucleotide g34872MterEco
cgagaattcgatgatttagctgggaggacccaa

SEQ ID NO: 49 - DNA, 26 bp, Artificial Sequence
  oligonucleotide g34872LR1305nBam
tcgggatccagtcacacaggccaggt

SEQ ID NO: 50 - DNA, 40 bp, Artificial Sequence
  oligonucleotide g34872LF1140ECOR1
gctgggaattcgctggaaaagctgatgggtgctgattctc

SEQ ID NO: 51 - DNA, 35 bp, Artificial Sequence; identical to SEQ ID NO: 47
  oligonucleotide g34872LR1309nBAmH1

SEQ ID NO: 52 - DNA, 31 bp, Artificial Sequence
  oligonucleotide g34872LF1064Eco
tcagaattctcatctctgcttcacaatgccg

SEQ ID NO: 53 - DNA, 35 bp, Artificial Sequence
  oligonucleotide g34872exRBAM139
acgggatcctttcagtactgaagttgagagggaga

SEQ ID NO: 54 - DNA, 1158 bp, Pan troglodytes
gtccacctgctgatagtgcgctccttaggtgcctgtctctggctgtcctgtgccacctgcacagagtcatgcatgagctccactgtgggaagtctctagagatgagctgagcttaccctacaccaactgaaagagtctatcttagtcctgaagatctcaagtcatcctcatattcccatgaatgtgaatggaagttgggcctgctcagagaatcatcagggctctttattgtggcctggagccaactgccaaggaatgcctaggaacacactcagtaagagtgttgccctcaggccagatcagacttgaacctgcagagaaatcccctaggtatgtcagcaattgctcatttggatgctataaacttgaagttgtgaaaaatataaagacttacattatccagtctctcctggcaaaatatgtaggtttaatcatacctgaattttccttagttcacacagatatacagatatatatcctaaaaattggcattggtaggtgtgtcaagttatcattttgaaaacatagaaacctgaacaagatgtatcactccagtctagaatgtctatatgcagagtatccacaaaaaaccaaacttcaacattctttcatgtctatattccttcaacattctttgtcttcaacattctttcatgtctagaatgtctatatgcaaagtatccacaaaagacccaaacttttttcatttaaagaaccaaacttctttaaataaaaatgactcacaataatttaatattttaccatttacaaagagattaactacaacaatattcatcttgagttaatttcccatgaataactttttcatttcttaaaatttgctgaatggaaagccagaaagcagagtgaagcaagtaatgtgtgtgtgagtagtcattggatacacgcataacagtgagcaagtttctcagctcctgcatggcagtgttctgattatcttttgctgcaaaagagctacaccccaaattagtggcttaaagtaaaagctcactagtgtatatgatgattctgttggtccaggatttggaaagggcatggcaggatgtctcatctctgcttcacaatgccgatgatttagctgggaggacccaaaatgctggaaaagctgatgggtgctgattctctccagcttttcag

SEQ ID NO: 55 - DNA, 92 bp, Pan troglodytes
  misc_feature 71..72: n=a, g, c or t
atccagatatacattgggtaaaatctacttcataggttttcaaaggagcattcttctgagcaaatctgaannaactctctaaaactccattg

SEQ ID NO: 56 - DNA, 152 bp, Pan troglodytes
caaaggagacagagagaagaaggaagagagacggtaacaaggaaagaaggatggaagagaaggcatgaggacggctatttggaaatggcacagaggcattgacagagatcattgtgtcctagggtctcttaccttcctcagccctgcacaga

SEQ ID NO: 57 - DNA, 94 bp, Pan troglodytes
acattccaaggtgattctaaatggcaatttgcactgtcattttaaaagaatttctcagatatttgctgggcactttatggaaggagacactgag

SEQ ID NO: 58 - DNA, 141 bp, Pan troglodytes
gaacacagaagcttttgtagtgttggtgctaaaatggttcccttgtcagaggagttacgttttatgagatcctctaagcaaatttagaaaaggagaggaacttgaccacagaaactgtgtttgatacatttgagcagcaaa

SEQ ID NO: 59 - DNA, 316 bp, Pan troglodytes
  misc_feature 8,265: n=a, g, c or t
actctttncagagacattttaactcacgatttgggaaaaccaatgagagaagaaaaaagaaattcttatctgaaacttgaacttatcaaaactcacttgtctagaaattagcctgggaacatccaggcactggaattcctcactttttttccttctccctctcaacttcagtactgaaaggagaaagtcatttccaaatgtctatgttttgactttttaaatagaccaaatttagagtcatgtaaagatacaataattagctttncttaataattttcacccagaggtatttttatagagaataaaaacaacaaca

SEQ ID NO: 60 - DNA, 388 bp, Pan troglodytes
gagctgggacttctaaccaatggaacatgggaaaggtgatgagacgtgactccggtgatgaggttaccttttacaagacttggccaactgagactggatctccttacaggctttaagaagtaagcagccatgttggaaaagtcttcatggcaaggaactatgagtggcctctaaggaccgcaggcagcctctagaacgaatgtggacctgcaactacaaccagcaaaaagaccagtcatgcaaccacaaggaaataacttccaccaaagccgaatgagtttggaagcagattcttcccagccattccttctgatgacaatgtagtctggccaacatcttcactggactctgacggactctgtgtctgggaaccagctgataacacgtg

SEQ ID NO: 61 - DNA, 35 bp, Pan troglodytes
gagctgggacttctaaccaatggaacatgggaaag

SEQ ID NO: 62 - DNA, 279 bp, Pan troglodytes
gctttaagaagtaagcagccatgttggaaaagtcttcatggcaaggaactatgagtggcctctaaggaccgcaggcagcctctagaacgaatgtggacctgcaactacaaccagcaaaaagaccagtcatgcaaccacaaggaaataacttccaccaaagccgaatgagtttggaagcagattcttcccagccattccttctgatgacaatgtagtctggccaacatcttcactggactctgacggactctgtgtctgggaaccagctgataacacgtg

SEQ ID NO: 63 - DNA, 50 bp, Pan troglodytes
gtgatgggattgtatttgcaactctctggtcagtaagtgataaaatgcca

SEQ ID NO: 64 - DNA, 84 bp, Pan troglodytes
ttttattattattgttttgtttccttgtttttaggtgatgggattgtatttgcaactctctggtcagtaagtgataaaatgcca

SEQ ID NO: 65 - DNA, 1152 bp, Hylobates sp.
  misc_feature 115: n=a, g, c or t
gtccacctgctgacagtgcgctccttaggtgtctgtctctggctgccctgtgccatctgcgcagaatcatgcatgagctccactgtgggaagtctctagagatgaactgagcttnaccccacaccaactgaaagagtctatcttagtcctgaaggtctcaagtcatcctcatgtccccatgaatgtgaatggaagctgggcctgctcagagaatcatcagggctctttattgtggcctggagctaactgccaaggaatgcctaggaacacacttagtaagagtgttgccctcaggccagatcagacttgaacctgtggagaaatcccctaggtatgtctgcaattgctcatttggatgctataaacttgaagttatgaaaaatacaaagacttacattatccagtctctcctgagaaaatatgtaggtttaatcattcctgaattttccttagttcacacagatatatatcctaaaaatttgcattggtaggtgtgtcaagttatcattttaaaaacatagaaacctgaacaagatatatcactccagtctagaatgtctatatgcagagtatccacaaaagaaccaaacttcaacattctttcatgtctatatgccttccacattctttgtcttcaacattctttcatgtctagaatgtctatatgcagagtatccacaaaagacccaaacttctttcatttaaagaaccaaacttctttaaataaagatgattagcaataatttaatattttaccatttacaaagagtttaactacaacaatatacatcttgagttaatttcccatgaataacattttcatttcttaaaatttgctgaatggaaagccagaaagtagagtgaagcaagaaatgtgtgtgtgagtagtcattggatatacacataatagtaagcaagtttatcagctcctgcatggcagtgttctgattatcttttgctgcataagaactacaccccaaattagtggcttaaagtaaaagcttcctattgtatatgatgattctgttggtccaggatttggaaagggcatggcaggaggtctcatctctgcttcacaatgcctatgatttagccgggaggacccaaaaggctggaaaagctgatgggtgctgattctctccagcttttcag

SEQ ID NO: 66 - DNA, 135 bp, Hylobates sp.
ggtataaaggaatctgaacgcgactgatattttctttaatttttagatccagatatatatcgggtaaaatctacttcataggttttcaaaggaacattcttctgagcaaatctgaaaactctctaaactccattg

SEQ ID NO: 67 - DNA, 89 bp, Hylobates sp.
atccagatatatatcgggtaaaatctacttcataggttttcaaaggaacattcttctgagcaaatctgaaaactctctaaactccattg

SEQ ID NO: 68 - DNA, 148 bp, Hylobates sp.
caaaggagacagaagaaggaagagagaaggtaacaaggaaagaaggatggaagagaaggcatgaggacagctatttggaaatggcacagaggcatttacagagatcattatgtccttgcgtctcttaccttcctcagccctacacaga

SEQ ID NO: 69 - DNA, 94 bp, Hylobates sp.
  misc_feature 54: n=a, g, c or t
acattccaaggtgattctaaatggcaatttgcactgtcattttaaaagaatttntcagatatttgcggggcactttatggaaggagacactgag

SEQ ID NO: 70 - DNA, 57 bp, Hylobates sp.
gaacacagaagcttttgtagtgttggtgctaaaatggttcccttgtcagaggagtta

SEQ ID NO: 71 - DNA, 313 bp, Hylobates sp.
  misc_feature 21: n=a, g, c or t
actctttcagggacatttttnactcacgatttgggaaaaccaacgagagaaagaaaaagaaattcttatctgaaacttcaacttatcaaaactcacttgtctggaaattagcctgggaatatccaggcactggaatttctcactttttttccttctctctcaacttcagtactgaaaggagaaagtcatttccaaatgtccatgttttgactttttaaatagaccaaatttagagtcatgtaaagatacaataattagccttcttaacaattttcactcagaggtatttttatagagaataaaaacaacaaca

SEQ ID NO: 72 - DNA, 389 bp, Hylobates sp.
  misc_feature 365,369,372,376,381: n=a, g, c or t
gagctgggacttctaaccaatggaacttgggaaaggtgatgagacgtgactccggtgatgaggttaccttacacaagacttggccaactgagaccagatctccttacaggcttgaagaagtaagcagccatgttggaaaagtcctcatggcaaggaagtatcagtggcctctaaggactgcaggcagcctctagaacgaatgtggacctgcaactacaaccagcaaaaagaccagtcatgcaaccacaaggaaataacttctaccaaagctgaatgagtttggaagcagattcttcccagccaatccttctgacgacaatgtagtctggccaacatcttcactggactctgacggactctgtgcngggnganccanctganaacacatg

SEQ ID NO: 73 - DNA, 35 bp, Hylobates sp.
gagctgggacttctaaccaatggaacttgggaaag

SEQ ID NO: 74 - DNA, 280 bp, Hylobates sp.
  misc_feature 256,260,263,267,272: n=a, g, c or t
gcttgaagaagtaagcagccatgttggaaaagtcctcatggcaaggaagtatcagtggcctctaaggactgcaggcagcctctagaacgaatgtggacctgcaactacaaccagcaaaaagaccagtcatgcaaccacaaggaaataacttctaccaaagctgaatgagtttggaagcagattcttcccagccaatccttctgacgacaatgtagtctggccaacatcttcactggactctgacggactctgtgcngggnganccanctganaacacatg

SEQ ID NO: 75 - DNA, 333 bp, Gorilla gorilla
  misc_feature 58,95,165: n=a, g, c or t
gagggtttggaattttcttcaagatgcacatttttctttctttaacctttaaggaaancgagttgaagcgcgtcatggtatgtatttctacagcnaaccactttgcttctgcaatttcagacactttacactgtctttcaggaataaataccatttgagaaagantggcgggggtagcacatctctccagcctcaaactattccttcctcagggcagaatttccccgtgatgctctcttgtcatcatcaccttcttcttgtctgaactcatcaacatttcagccaaattactgtgctgctaagtcactgggaagatcaggaccccacaccaag

SEQ ID NO: 76 - DNA, 1158 bp, Gorilla gorilla
  misc_feature 493,1055: n=a, g, c or t
gtccacctgctgatagtgcgctccttaggtgcctgtctctggctgtcctgtgccacctgcacagagttatgcatgagctccactgttggaagtctctagagatgagctgagcttaccctacaccaactgaaagagtctatcttagtcctgaagatctcaagtcatcctcatattcccatgaatgtgaatggaagttgaacctgctcagagaatcagcagggctctttattgtggcctggagccaactgccaaggaatgcctaggaacacactcagtaagagtgttgccctcaggccagatcagacttgaacctgcagagaaatcccctaggtatgtcatcaattgctcatttggatgctataaacttgaagttgtgaaaaatttaaagacttacattatccggtctctcctggcaaaatatgtaggtttaatcattcctgaattttccttagttcacatagatatacagatatataccctaaaaattggcatnggtaggtgtgtcaagttatcattttaaaaacatagaaacctgaacaagatgtatcactccagtctagaatgtctatatgcagagtatccacaaaaaaacaaacttcaacattctttcatgtctatattccttcaacattctttgtcttcaacattctttcatgtctagaatgtctatatgcaacgtatccacaaaagacccaaacttctttcatttaaagaaccaaacttctttaaataaaaactactcacaataatttaatattttaccatttacaaagagattaactacaacaatattcatcttgagttaatttcccatgaataactttttcatttcttcaaatttgctgaatggaaagccagaaagcagagtgaagcaagtaatgtgtgtgtgagtagtcattggacacatacataacagtgagcaagtttatcagctcctgcatggcagtgttctgattatcttttgctgcaaaagagctacaccccaaattagtggcttaaagtaaaagcttactattgtatatgatgattctgttggtccaggatttggaaagggnatggcaggaggtctcatctctgcttcacaatgccaatgatttagctgggagaacccaaaatgctggaaaagctgatgggtgctgattctctccagcttttcag

SEQ ID NO: 77 - DNA, 135 bp, Gorilla gorilla
ggtataaaggaatctgaacacgactgatattttctttaatttttagatccagatatacattgggtaaaatctacttcataggttttcaaaggagcattcttctgagcaaatctgaaaactctctaaactccattg

SEQ ID NO: 78 - DNA, 89 bp, Gorilla gorilla
atccagatatacattgggtaaaatctacttcataggttttcaaaggagcattcttctgagcaaatctgaaaactctctaaactccattg

SEQ ID NO: 79 - DNA, 152 bp, Gorilla gorilla
caaaggagacagagagaagaaggaagagagacggtaacaaggaaagaaggatggaagagaaggcatgaggacggctatttggaaatggcacagaggcatttacagagatcattatgtccttgggtctcttaccttcctcagccctacgcaga

SEQ ID NO: 80 - DNA, 94 bp, Gorilla gorilla; identical to SEQ ID NO: 57

SEQ ID NO: 81 - DNA, 139 bp, Gorilla gorilla
  misc_feature 83: n=a, g, c or t
gaacacagaagcttttgtagtgttggtgctaaaatggttcccttgtcagaggagttacgttttgagatcctctaagcaaattnagaaaaggagaggaacttgaccacagaaactgtgtttgatacatttgagcagcaaa

SEQ ID NO: 82 - DNA, 315 bp, Gorilla gorilla
  misc_feature 16: n=a, g, c or t
actctttcagagacanttttaactcacaatttgggaaaaccaatgagagaagaaaaaagaaattcttatctgaaacttgaacttatcaaaactcacttgtctagaaattagcctgggaacatccaggcactggaatttctcactttttttccttctccctctcaacttcggtactgaaaggagaaagtcatttccaaatgtctgtgttttgactttttaaatagaccaaatttagagtcatgtaaagatacaataattagctttcttaataattttcacccagaggtatttttatagagaataaaaacaacaaca

SEQ ID NO: 83 - DNA, 388 bp, Gorilla gorilla
gagctgggacttctaaccaatggaacatgggaaaggtgatgagacgtgactccggtgatgaggttaccttttacaagacttggccgactgagactggatctccttacaggcttgaagaagtaagcagtcatgttggaaaagtcttcatggcaaggaactatgagtggcctctaaggaccgcaggcagcctctagaacgaatgtggacctgcaactacaaccagcaaaaagaccagtcatgcaaccacaaggaaataacttctaccaaagccgaatgggtttggaagcagattcttcccagccaatccttctgatgacaatgtagtctggccaacatcttcactggactctgacagactctatgtctgggatccagctgataacacgtg

SEQ ID NO: 84 - DNA, 35 bp, Gorilla gorilla; identical to SEQ ID NO: 61

SEQ ID NO: 85 - DNA, 279 bp, Gorilla gorilla
gcttgaagaagtaagcagtcatgttggaaaagtcttcatggcaaggaactatgagtggcctctaaggaccgcaggcagcctctagaacgaatgtggacctgcaactacaaccagcaaaaagaccagtcatgcaaccacaaggaaataacttctaccaaagccgaatgggtttggaagcagattcttcccagccaatccttctgatgacaatgtagtctggccaacatcttcactggactctgacagactctatgtctgggatccagctgataacacgtg

SEQ ID NO: 86 - DNA, 104 bp, Gorilla gorilla
gtgatgggattgtatttgcaactctctggtcagtaagtgataaaatgccatttctatgcacccacctggcctgtgtgactgggagaatctctggatcccgcata

SEQ ID NO: 87 - DNA, 126 bp, Gorilla gorilla
ttttcttattattgttttgtttccttgtttttaggtgatgggattgtatttgcaactctctggtcagtaagtgataaaatgccatttctatgcacccacctggcctgtgtgactgggagaatctct

SEQ ID NO: 88 - DNA, 1055 bp, Pongo pygmaeus
  misc_feature 297,306,844,854,1021,1037: n=a, g, c or t
gtccacctgctgacagtgcgctccttaggtgtctgtctctggctgtcctgtgccacctgcccagagtcgtgcatgagctccactgtgggaagtctctagacatgagctgagcttaccctacaccaactgaaagaatctgtcttagtcctgaagatctcaagtcatcctcatattcccatgaatgtgaatggaagctgggcctgttcagagaatcatcagtgctctttattgtggcctggagccaactgccaaggaatgcctaggaacatactcagtaagagtgttgccctcaggccnagatcagancttgaacctgcagagaaataccctaggtatgtcagcaattgctcatttggatgatataaacttgaagttgtgaaaaatataaagacttacattatccagtctctcctggcaaaatatgtaggtttaatcattcctgaactttccttagttcacacagatatatatcctaaaaattggcaatggtaggtgtgtcaggttatcattttaaaaacatagaaacctgaacaagatatatcactccagtctagaaggtctatatgcagagtatccacaaaagacccaaacttctttcatttaaagaaccaaacttctttaaataaaagtgactcacaataatttaatattttaccattgacaaagagattaactacaacaatattcatcttgagttaatttcccatgaataacattttcatttcttaaaatttgctgaatggaaagccagaaagtagagtgaagcaagtaatgtgtgtgtgagtagtcattggatacatacataacagtgaacaagtttatcagctcctgcatggcagtgttnctgattatcnttttgctgcaaaagaactacaccccaaattagtggcttaaagtaaaagcttactattgtatatgatgattctgttggtccaggatttggaaagggcatggcaggaggtctcatctctgcttcacaatacctatgatttagctgggaggacccaaagggctggaaaangctgatgggtgctganttctctccagcttttcag

SEQ ID NO: 89 - DNA, 135 bp, Pongo pygmaeus
  misc_feature 102: n=a, g, c or t
ggtataaaggaatctgaacatgactgatattttctttaatttttagatccagatatatattgggtaaaatctacttcataggttttcaaaggaacattcttntgggaaaatctgaaaactctctaaactccattg

SEQ ID NO: 90 - DNA, 89 bp, Pongo pygmaeus
  misc_feature 56: n=a, g, c or t
atccagatatatattgggtaaaatctacttcataggttttcaaaggaacattcttntgggaaaatctgaaaactctctaaactccattg

SEQ ID NO: 91 - DNA, 152 bp, Pongo pygmaeus
caaaggagacagagagaagaaggaagagagaaggtaacaaggaaagaaggatggaagagaaggcatgaggacggctatttggaaatggcacagaggcaattacagagattattatgtccttgggtctcttaccttcctcagccctatgcaga

SEQ ID NO: 92 - DNA, 94 bp, Pongo pygmaeus
acattccaaggtgatactaaatggcaatttgcactgtcattttaaaagaatttctcagatatttactgggcactttatggaaagagacactaag

SEQ ID NO: 93 - DNA, 141 bp, Pongo pygmaeus
  misc_feature 97,122: n=a, g, c or t
gaacacagaagcttttgtagtgttggtgctaaaatggttcccttgtcagaggagttacgtcttatgagatcctctaagcaaatttagaaaaggagangaacttgaccacagaaactgtgttngatacatttgagcagcaaa

SEQ ID NO: 94 - DNA, 313 bp, Pongo pygmaeus
actctttcagagacatttttactcacgatttgggaaaaccaatgagagaagaaaaaagaaattcttatctgaaacttcaacttatcaaaactcacttgtctagaaattagcctgggaatatccaggcactggaatttctcactttttttccttctccctctcaacttcagtactgaaaggagaaagtcatttccaaatgtctatgttttgacttttaaatagaccaaatttagagtcatgtaaagatacaataattagctttcttaacaactttcacccagaggtatttttatagagaataaaaacaacaaca

SEQ ID NO: 95 - DNA, 389 bp, Pongo pygmaeus
  misc_feature 376: n=a, g, c or t
gagctgggacttctaaccaatggaacacgggaaaggtgatgagacatgactccggtgatgaggttaccttatacaagatttggccaactgagaccagatctccttacaggcttgaagaagtaagcagccatgttggaaaagtcctcatggcaatgaactatgagtgacctctaaggactgcaggcagcctctagaacgaatgtggacctgcaactacaaccagcaaaaagaccaatcatgcaaccacaaggaaataacttctaccaaagctgaatgagtttggaagcagattcttcccagccaatccttctgatgacaatgtagtctggccaacatcttcactggactctgacggactctgtgtctgggacccagnctgatagcacatg

SEQ ID NO: 96 - DNA, 35 bp, Pongo pygmaeus
gagctgggacttctaaccaatggaacacgggaaag

SEQ ID NO: 97 - DNA, 280 bp, Pongo pygmaeus
  misc_feature 267: n=a, g, c or t
gcttgaagaagtaagcagccatgttggaaaagtcctcatggcaatgaactatgagtgacctctaaggactgcaggcagcctctagaacgaatgtggacctgcaactacaaccagcaaaaagaccaatcatgcaaccacaaggaaataacttctaccaaagctgaatgagtttggaagcagattcttcccagccaatccttctgatgacaatgtagtctggccaacatcttcactggactctgacggactctgtgtctgggacccagnctgatagcacatg

SEQ ID NO: 98 - DNA, 58 bp, Pongo pygmaeus
gtgataggattgtatttgcaactatctggtcagtaagtgataaaatgccagtctatgc

SEQ ID NO: 99 - DNA, 92 bp, Pongo pygmaeus
  misc_feature 18: n=a, g, c or t
ttttcttattattgttangtttccttgtttttaggtgataggattgtatttgcaactatctggtcagtaagtgataaaatgccagtctatgc

SEQ ID NO: 100 - DNA, 854 bp, Macaca mulatta
  misc_feature 248,250,257..258,260,263..266,268..271,276,278..279,283,285..286289,292,294..295,297,299,301..303,307..309,312..313,316,318,321323,350,358,365,368,372..373,375..377: n=a, g, c or t
tgctcatttggatgctgtaaacttaacgttgtgaaaaatataaagacttatgttatccagtctctcttgggaaaatatgtaggtttaatcattcctgaattttccttagttcacacagatttatgtcctaaaaattggcattgggtaggtgtgtcaagttatcattttaaaaacatagaagcttgaacaagacatatcactccagtctagaatgtctatatgcagagtatccacaaaagaacccaacntnaaaattnncnttnnnnannnntgtcnanntatncnnttnaananncntngnnncttnnncannacntntcntnttcatgtctagaatatctatatgcagnagtatccnacaaaangancccnncnnnaaacttctttcatttaaagaaccaaacttctttaaataaaaatgactagcaataatgtagtattttaccatttacgaagagtttaacgataacaatattcatcttgagttaatttctcatgaataacattctcatttcttaaaatttgctgagtggaaagccagaaagtagagtgaagcaagtcatgtgtgtgtgagtagtcattggatacacgcgtaacagtgagcaggtttatcagctcctgccatggcgcagtgttctgattatcttttgctgcataagaactactccccaaattagtggcttcaagtaaaaacttactattgtgtaggatgattctgctgagccgggatttggaaagggcacgcaggaggtctcatctcttctcatctctgcttcacaatgcctgtaatttagctgggaggacccaaaaggctggaaaagctgatgggtgctgtgtctctccagtcttttcag

SEQ ID NO: 101 - DNA, 126 bp, Macaca mulatta
ataaaggaatctgaacacgactgatattttctttaatttttagatccagatatacattgggtaaaacttcataggttttcaaaggaacagtcttctgagcaaatctgaaaactctcaactccattg

SEQ ID NO: 102 - DNA, 83 bp, Macaca mulatta
atccagatatacattgggtaaaacttcataggttttcaaaggaacagtcttctgagcaaatctgaaaactctcaactccattg

SEQ ID NO: 103 - DNA, 143 bp, Macaca mulatta
  misc_feature 6,8,12..14: n=a, g, c or t
caaagnanacannnagaagaagagagaaggtaacaaggaaagaaggatggaagagagggcatgaggacagttatttggaaatggcacagaggcatttacagagatcattatatccttgagtcctttaccttcctcagccctat

SEQ ID NO: 104 - DNA, 94 bp, Macaca mulatta
acattccaaggtgattctaaatggcactttgcactgtcattttaaaagaatttctcagatatttgctgggcactttatggaaggagacactgag

SEQ ID NO: 105 - DNA, 137 bp, Macaca mulatta
  misc_feature 25,31..32,111,114: n=a, g, c or t
accacagaagcttttgcagtgttgngtgccnnaatggttctcttgtcagaggagttacgtcttacgagatcctctaagcacatttacgaaaggagaggaacttgaccacanaanactgtgtttgatacatttgagca

SEQ ID NO: 106 - DNA, 277 bp, Macaca mulatta
  misc_feature 177,179,241: n=a, g, c or t
gctctttcagagacatttttactcatgatttggaaaaaccaacaagagaagaaaaaagaaattcttatctgaaacttgaacttatcaaaactcacttgtctagaaattagcctgggaatatccaggcactggaatttctcactttttttccttctccctctcaacttcagtactganangagaaagtcatttccaaatgtctatgttttgaatttttaaatagaccaaatttagagtcatntaaagatataataattagctttcttaacaattttca

SEQ ID NO: 107 - DNA, 389 bp, Macaca mulatta
  misc_feature 377: n=a, g, c or t
aagctgggacttctaaccaatggaacatgggaaaggtgatgagacgtgactccggtgatgaggttacattatccaagacttggccaactgagaccagatctccttacaggcttgaagcagtcatcagccatgttggaaaagtgctcatggcaaggaactatgagaggcatctaaggacttcaggcagcatctagaatgaatgtggacgtactactacaaccagcaaaaagaccagtcatgcaaccacaaggaatgaacttctaccaaagctgaatgggtttggaagcagactcttcccagccaatccttctgatgaaaatatagtctggccaacatcttcactggactctgatggactctatgcctggaacccagcntgataagacatg

SEQ ID NO: 108 - DNA, 35 bp, Macaca mulatta
aagctgggacttctaaccaatggaacatgggaaag

SEQ ID NO: 109 - DNA, 280 bp, Macaca mulatta
  misc_feature 268: n=a, g, c or t
gcttgaagcagtcatcagccatgttggaaaagtgctcatggcaaggaactatgagaggcatctaaggacttcaggcagcatctagaatgaatgtggacgtactactacaaccagcaaaaagaccagtcatgcaaccacaaggaatgaacttctaccaaagctgaatgggtttggaagcagactcttcccagccaatccttctgatgaaaatatagtctggccaacatcttcactggactctgatggactctatgcctggaacccagcntgataagacatg

SEQ ID NO: 110 - DNA, 74 bp, Macaca mulatta
  misc_feature 6: n=a, g, c or t
gtgatnggattgtatttgcaactatctggtccataagtgataaaatgccatttccatgcacccaccggcctgtg

SEQ ID NO: 111 - DNA, 108 bp, Macaca mulatta
  misc_feature 32,40: n=a, g, c or t
ttttcttattattgttttgtttccttgttttnaggtgatnggattgtatttgcaactatctggtccataagtgataaaatgccatttccatgcacccaccggcctgtg

SEQ ID NO: 112 - DNA, 514 bp, Homo sapiens
  allele 380: 99-30329-380 : polymorphic base C or T
  misc_binding 368..392: 99-30329-380.probe
  primer_bind 361..379: 99-30329-380.mis
  primer_bind 381..399: 99-30329-380.mis complement
  primer_bind 1..18: 99-30329.pu
  primer_bind 496..514: 99-30329.rp complement
gacataccccaaacacagcagcacaaagcaactgcctgtgattgtcaattatctgcactaactttgaatagacaactgagagtaaaattgaccattagctgttattaatcttttaaatagcttatttatcaggacaatattttctttgaggaatggtttcacatcgttgataaacagtttcctattactaacattaaactaaataatatatgtcatatttcttttttacccttagaaagttaatctaataatattattctgattagtggtactttttttaatttttgtaatgttgtttatggtgtttgatttgtacttttttgtctttttcataccttttaataacatccgatttactactggagcattttattttcatygtctcttaaaatacttaataacttttagatttgttgttcacaaaactaaataattgcttgatgtttcattttatccttcttattaaataggcagctcgtgtacatatgaaagtgtctttttatacaccgaaacc

SEQ ID NO: 113 - DNA, 617 bp, Homo Sapiens
  allele 330: 99-16081-217 : polymorphic base C or T
  misc_binding 310..329: 99-16081-217.mis1,
  misc_binding 331..349: 99-16081-217.mis2, complement
  primer_bind 114..131: upstream amplification primer
  primer_bind 556..575: downstream amplification primer, complement
  misc_binding 318..342: 99-16081-217  probe
  misc_feature 4,607: n=a, g, c or t
ctcngggaggccaaaggggtcgcccctggggcagatgtctatgggagaagcccaagggacgcagaggccaggggaggagcacacaccacaggcagatgtgtgggggaggagcccaaaggacagagaaccagcaggcaggccctgggtcaagccccgtgatgtcccaggaggaggggaggagggcggagtcggaagggagcgagggagccagggaggcagggccctctgagggcagggagttctccatgaagttccagaagccaatgaccagatcggcgcatgcaaacagcttaaaagaaaacattaggcactggtggcttcgctctaaaygaacagttcttaaaactgctttcagttctagccataataaaggcatttgaattatgttgcttttgatgaaactataaagatattggcttttatacagtatcatgccagaaacaaatttataacattgttatggtataacagcaggaatacttggaatacacatttttcagctgagctctaagaattacttttcccttgccccaggttggcaattaagaactataacttacttccaccccactccacctcaccctaccccagaaacaaagaaaaacanacacgcaaac

SEQ ID NO: 114 - DNA, 642 bp, Homo Sapiens
  allele 233: 99-16082-218 : polymorphic base A or G
  misc_binding 214..232: 99-16082-218.mis1
  misc_binding 234..253: 99-16082-218.mis2,  complement
  primer_bind 16..33: upstream amplification primer
  primer_bind 527..547: downstream amplification primer, complement
  misc_binding 221..245: 99-16082-218  probe
  misc_feature 486,611,613: n=a, g, c or t
gaagcgggaactgtgcaattcagcaagagccactttggttaacaaaccttctgggaatgaaggtgctttacaaagaagcaggctgtgataaaaacaaacaagacaacattcataaactgtgggaagcattgttgtcattgggtcacacctcctgcaccaggcaggtggttgtctgctgcgttcctttacagaacagatgctgagcctgcctggaggtggcaatttaccaatcratggtcttaagcaattccaaaggctggggtaaggggtagaaaagagaagctcaaaaatgttagggatggagaaggggggagtgattcaggaagaggagaaacctgttcatttcctcccaaattacaaccactgtcacatccatggctagtcctgtgcaaacttccagtccccagctgatatccctgcagacaagtagagagaggctagaacaaaagctaaagtgtagatgtcccatacactaatcagtgttgntttttaatcagaggttgaaattcatactctgatgcaaactgtattagtcagttgttgctgctatgataacactgcataacaaacaaccccccaaatctcagtggattacaaggacaaacatttgngnttctctttcatgggcctatgtgttggctg

SEQ ID NO: 115 - DNA, 3001 bp, Homo Sapiens
  allele 1501: 99-15056-99 : polymorphic base G or A
  misc_binding 1502..1521: 99-15056-99.mis1,  complement
  misc_binding 1482..1500: 99-15056-99.mis2
  primer_bind 1582..1599: upstream amplification primer, complement
  primer_bind 1098..1118: downstream amplification primer
  misc_binding 1489..1513: 99-15056-99  probe
cacaccaacatggcacatgtatacatatgtaacaaacctgcacgtcgtgcacatgtaccctaaaacttaaagtataataataataataatagtaaagactttaataatcccaaagccaagtttccactctaagtggtgtaagagtttgtgctcagtagagtcatagcttttatatagttgatgaaagatttgggttccctaaaagatatttctagtcaacccatgtatcttaaacaccatgattcattttaaaatccattttactaactgtcaagccgtctcatattgatcaaaataaagatagtcgaagcacacacaataacaaatttctgggatataaccttccaactgtagtattccaatgaggccactttaaatactaacatacatacttaaggtatagactaccgtgatttactgcatataaatgtatagaactgaacatactggactatttaaaactgaattatatataatatagcagacagacaatatatattattactgtgataactattatgaccaattagtactaaggcaaactagaagaaatttgaaaaacaaatttcacaatcaaaatgccatccaggtttcccttacatctctgtcctatttttacacatcgtttaatgtcacacacacacacacacacacacacccccatcattattaagagagatatatatcagaataggtatgtaatccaggtttatttacatttaattatctgtaaccaaaagtaatttttcagaaaaatacacattatttaaaatactgacatgaaaattagcatgtttatttcatgctaacaataaaattatttttaatcacaagtttttatttctaagatgtttcatagaaatacttgaagaatataagcaacagtaaattatgtgctggttctataatagacaataaaaggctgatttcctaaaatatttatttataatctgaataaattattaaatttatttagttgaaagtaatccagcattttaagtaaaatatccattttcagataaaataggtatttagcaataataactttaggatgtctaggcagtttataaacacatggaatgatagttatattacataaaagggagacgtattttggggaacaccaaacatatttatagaaccaaaggtcaattatgcctatgtttacaataacttgagacattggtgtttttctattaacaatcatagatcaactgttgctcactgtttcatcgaaacaaatattgtgaggagcacaaaggggttcaaaagaaggctagatcacaagcttattcctaaatgaatttatgatcatctagttttagaattaagatccaaaaataagaggcaaagaaaattaaagttacatagtgagcaatgcaaatcggcatttgattaagtggtaacttgtttgatataaacataagcacagagaatataaaacaggagaaattattatttaggaagtctacgtggagaaattattatgggaactataaargcactcatagccacttgtaaattgtaagagttaagaaggcctttgcctctttattcaggaggtgctcgaaggaaatctggcttcttgtgagtttcctggaagttaggctttgactgtacaatgggaggaagggagtacatttatcttaatttttatttatttctccttaatgccttttaaatgatgttttaaaacaaaacgtacttatatttccattatacaaataaagaaaggcacattcttgtctcatgctttatagggcggcttcagagctgcagttttcagactagttgatctttatgttctaaaaaaattattgggtattccaaagaccttttgattttgtagttatattgatcaatatttaccatattagaaattaaatcatccaaaaaattttaagttgtttgtttattaaaatgacaacacaatgtgcattacgtgataacatattagtttcattaaaataactatattttccacaacctaaaagcaggtgagaagaaatggcgttgcttaatatttttgcctatctctttaatgactcacctaataaaataaagctttattttcatgtcagctttttcattcaatatatcacaattcattgttttgtttaaggtatatgaaaaaaatggcaagcctcacagagatatggataatggttgaaaaagcctttgcagataactatggatatcctttgttcttcatacgacccgaaagctttacaaatggatttttaaagtttcttgtgatgtgtaatctgaaacgatatgaatacacttttgtactcttttttaatgaaaaggcactaatctatcttgcacttcgaataaatattttactcaccaatgattttatagcatcatgcattggtcatttggagaatattgattttctgacatataaatcttccaaacattggcataatttattatctaatataagacatatcacattcaagtattcggaaactgtgaaactttgcttgatagataagttttccaaatttctacttaatccttgaaagcttgagtttgctactggcaatagctactgtccgttgttttcccgaagtgactggctcacttcattcatttttgaggaagtctgccaaatgcccaaatgtggtgaaacttcatttctgtcagttgttctttcaagtagaagtggtgttccctaaaaaggaagaagctagttcagctcacagctccaacaatgcatgggtgcttctcctcaagaaaaccatcacatgctgtaggggctgacattctttcagaaaaggagacatgccaataaggctcaagatttaattacatgactaagttgtgtgacttcctcaggacattcattctcatgggaatctgaagttttattttttcccaggagtgtgaagtggtgaagacacgatagatgttagcacactcagagctatggcctcggcttctactgtggtaccatcccgtaaatatccacagtgaaaaaggatgacgacgtcct

SEQ ID NO: 116 - DNA, 3001 bp, Homo Sapiens
  allele 1501: 99-15063-155 : polymorphic base A or C
  misc_binding 1482..1500: 99-15063-155.mis1
  misc_binding 1502..1521: 99-15063-155.mis2,  complement
  primer_bind 1347..1364: upstream amplification primer
  primer_bind 1784..1804: downstream amplification primer, complement
  misc_binding 1489..1513: 99-15063-155  probe
aaaacctactgaaataaaataataaataaataaataaataaaaataaaagtgtgaactacagactcagtatcttaatatattgataaagcacaatgaagaattaaaggaagattgtgcacaaataaattgtgcaatcaagtcaccatccagtagccctgtgaaggaaacagggagacttggatcactagaggcataggaatgtcactctaggatgtgaactctgaactgaaatacttaaaagacgtagagctggacaagtcagagatagtggcatcccatggctactgattgaaacaaatcttttctgtaacagagtgtcacaacttagcatcacacaactcctatttaagagcaaacaatgagttttcaatcaataaacacaaatatatgagagtttggaccactgagattgaaaatcagcaatgacaaataagtgaatatgcatacatacaagttttaatgtgcccaaagacaaaaaatattagaatttttcaatacaaagtatggaataattatatataaatattttatttaaaaaagacacaatttcaaagactgatcagcagtaacacattatcagggataaatgcagaaatttgaaaacaaaacttctaggctgtatgtctaaatatatatcatataacattaattatataggtatatttaattatttaaatttgaaagtcgacataaagtttaccaatatattaaacggagttgaaaagaaacagagaaatggaaaatacaatctagtaaataatataagataaagtgaaatattaagaggtacgacaaaaatatgaaataatcataaaaatgtattaaagatagaatgagaagatcacatacacaacaattagagacagtagagaaaataagtgagagataatatttgaagatatgatggctgaaaatattccaaatctcattaaaacataaatctatagatataaatggtactatgtacttgggacaaataaaaataaacatacatatcttgtaataaggattaattggaagctattatctttaaaatcaggagcaacacaaagatgcttgctttcttagattctcttcaactatgtactagatcatggaaacaatgcagggaaagaaaaaaaggaataaaaacataagaattcggaagaagtaactataattatattatctaccttgaaattaaaaagaaatattacaggcagactactcacaataatatgagagtagcatgttatacaggtataagctcactggaaaaaaattggcatatttttagtatgtataccaaagccaaaattttaaaattgcgtttaaaaacacatttcatcaatcacatctcaataaagcagtcagaaacaaacagcaaaaacctattatgtacactatcaatataaacaacaaaccaactaaaaatacatcttacaaaatgcgtacaaaacatacgtggaaaaaatgctgaaactctacattaaaaagaccgtaaacatacagagtaaatamcatgctcttggttggaaagaaatagcgttccaaagatgtcaattctcccaaagttgagatatattctatgaaagtccaaataccaacagtttttttttcatggatctggtcaagctaaatctcaaatgtatataaaagaaagaccagccaagaaactaaagaagtggaggcttagatataatccataaataatcaaaatttaaaataaaacaatgaaaattaagggagaggatagaagcctcagaacatacttatggagtttcaatatatgacaaagcaggcctggtgggacctgtttaataaactattaatatatttttttgatgcataaacaaaatgtttttgatgcataatatatatattttgatgcataaacaaatatatatttttgatgcataaacaaacaaaaacataatatatatttttgatgcataaaacctgatatcagacttctgcttcacaacacacagacacacacacacctcttttagaaaataaaacaatatttttctgaccttttaataggaaagtattttcttaacagacccaatgtgctaattaaaataacagattgaaacactcaactacctttaaatttagaagttctgttcaataaaggagagtttaaaaagtgaagatgaatcaaaatctagaagatattcacaacatacacaacagacaagtactgaaacacaaaatataaattatcaagtcagagacacttattcaaaagaaattttgaatagtaacttcacagaagaggacacatgtatgttcaacgtcaacaaattccaaaaacggaggttacaaccacaatgagaaatcattttacacttgtgaaataagggaataaaagagcataacaatatgaactattggataagatatggatcaacaggaactcgtatacatttctgcgggaagataatggtagaaccaacttggaaaacaatttggcatttgtacagcatacaacccagaaattccatgcatagttatgaagtgaagaaacttgcaggaaccagcagatggtaaccaaagcaatccctagcggccctcattgcttattagcataagacactcccaccagcgtcatgacaatttacaagtgctatggcaatatctaggagtttgctgcccctctccatggcaaccagctggaaattgccgccctttccctacaaagttctaaataacttgagcctcaatttgtattagcctgacccttaattttgcaggtaattgaaggagggtataagtggaaataagtacagtggccaagagcccatcctttggggattctgggagcactgcctgtgagttagacctgctccgaaaggagcatcacgactcagtgagagattgctgtctaacaacacgcacttgaccttgaattctttcccaggtgaagccaggaacctccctgggcgaaaccccagtttggaggctcggttgtcctgaatcagttataacttggagaaatgtctgcagatgtgcttc

SEQ ID NO: 117 - DNA, 3001 bp, Homo Sapiens
  allele 1501: 99-15065-85 : polymorphic base C or G
  misc_binding 1502..1520: 99-15065-85.mis1, complement
  misc_binding 1481..1500: 99-15065-85.mis2,
  primer_bind 1568..1585: upstream amplification primer, complement
  primer_bind 1120..1140: downstream amplification primer
  misc_binding 1489..1513: 99-15065-85  probe
ctcttcacctaaatttatcttttatttattctctcatcattatcaacaactactaggctttgttgccttgactccagaggcaaaaatcttatctcccaacaatgtctcttaagttaagtgtaattcattatttgatattcttgtttcaaaatgggtagaggaaaacttcctgcatataccgtaaaataattttagggaaaatatactaatgtatgttccagagcactggaaggtccaaagctacctatttgcattgtaccattactatttgatgtagccttttgctcattatgcaatgagctgaaatacatttttcatcatgcctcctgagtctctaagtaagagtgattgactcattccttttctaccagtgagattgcaaagcaaaaagaaatatgtagtatttatttactcatggaattcattcttatgaaggtcagttgccaaatgatgccaaaaccttactttctagaatgctattcaagttatcaggctttaacgttttcaagatgtttatgtttgacaaccatatataacataaaattatgtgaagtaaagtataacataactgtttcttttctatgaaacatgcctatttcaagtacatagtacactgcactgcagataaccggctgataaccagctctcaacacatacaacctaatgattgaattaaaccatagtgtatatttttctaaatgtattcttaattaatcacattacaaccatcagtatttgggtgaacagcttcagcatccattagtttttgagcaaagaactagaattcggagcattcaaatgatactagagaaaagacatgaagactgtttatgagattggtccatctctgagaaatgtcaagatttaagaagagccgcaatttcaaaaccagggctacttcattgtggacctgaatctatttacccagggtcaaatcaaggatttggaacagaccatgggaacacaccactttcaatttttgaaatatttgcaaatacatgatgagatatcttggggatggaacccaagtctaaacagaaaatcaatgtatgtttcgtatctaccttatagacatagtctgaaggtaattttagataatatttttaatattttgtttgacaccaacattattcctgtctctgaatttatatgctacacataagcaatcattttattatacctattcacatgtaagtacttaacagttaaaaattgacataccattcatgcaataaaaaataatatgctgaaggtaactaagcagtatagcagcagcatcacaataaacaagctgttacaaaatagcaataacaaacaaaggaaggcttccagtctccacctacgagtctgtattttaatttaaaagttactgtacgctgtattattattattttatttgagaagaaacatcagaagcagtcgagggattaggaagtgggtcctctggggaagaggacatattcggctggatggcttctaaagtgtttcctccagtcatctscctcattaacaatattttttcttacaagcctctctttgattttataaactgacatgatttcttgctctatgaatccatgctgctccagtccttcaataagctgattaaacattttcattatgtcttctgtaggcactttctctgcagggttaacaatgtcatcttcattgccactattatcatgatcaccttgattctgaaccattttggctatttctccatcagtcaatgagtgaacaactgagccttaatatcaataacgtctataacattcttcaatgttcacttcatccagtttactgagggactctgaaggtatattttttgcatatgtaaagaggtcagacaacattttattctcacttgatacacagaatccctcaaagtcaccaccttattaatcctcatcactgagcatagttgcagacccagagggtatgctagacatgcatagctatgtatttagttcctgtgttccaagccttggcaaaagccaaaacagcatccttcatgctaagttcctttttagaaactttcatatttataccactattcactgatgctagctagcatggtattcaagaaagtattttttatattaattttcattgatctaaggatacctttgtcacacagctgaattaataaagtcacatttggggaaaacacatgaaataatcatgaatgtttaaagagaatttcagctgcaggatctgctgaacagttgtcaaggaataacaaaatcttgcagtcctcatccagtccagcttccctgcagtgaacatgagctgctggtacaaaatggtgatgaaaccagtcagaaaagctgcccctgatgacctatcctttttcattagcatagtaacgacctagtaagaaatgtactcatggaaagcagtgaggatgcaagctttgcctatcatggcgagtttacacttatgtacgcctgctgcattagcacagtgcaggtgttctgttcttggcattcttaattcctgtatgagctgtctcattggctgtagtcaattttggcagggaacaccaaaacagtgaagtttcattcgcattatagacttgttttggcatcagattttcttcctttttttttttattatactttaagttttagggtatatgtgcacaatgtgcaggtgagttacataggtatacatgtgccatgttggtgtgctgcacccattaactcgtcatttaacattaggtgtatctcctaatgctatccctccccctccccccagcccacaacaggccctggtgtgtgatgttccccttcctgtgtccatgtgttctcattgttcaatttccacctatgagtgagaacatgcggtgtttggttttttgtccttgcgatagtttgctgagaatgatggtttccagcttcatctgtgtccctacaaaggacaagaactcatcatgttttatggctgcatagtattccatggtgtatatgtgccacattttctcaatcctgtgtatcattgt

SEQ ID NO: 118 - DNA, 451 bp, Homo Sapiens
  allele 404: 99-15252-404 : polymorphic base C or T
  misc_binding 384..403: 99-15252-404.mis1,
  misc_binding 405..423: 99-15252-404.mis2, complement
  primer_bind 1..18: upstream amplification primer
  primer_bind 434..451: downstream amplification primer, complement
  misc_binding 392..416: 99-15252-404  probe
atgggggcatatagcaaccctttagaaacaaaactacaaaaggtaagcttgtcttcttgcatttcctttctcttactacatttaacatgggaggttttctatgtctcacattcaaatattctcactcgggctgcctaatttttccctgattttccatcactctttatgaaggcttgctactttagaatacacattttcttaacagaagataataatcagaagatgtctcccaaatataagtccaaatctttcctatcatgctgtgttctttggctcttttgactttatttgaagtcagccttgaaggggatagagataggctgtatgaagtccacgctgagaagttttgccctgccctacttgtcctgtaatatttcatggatagcccagtggtgattaaaccygtgtgtacaggaataaccatgagaatttgtaaaaatataggctctgg

SEQ ID NO: 119 - DNA, 3001 bp, Homo Sapiens
  allele 1501: 99-15253-382 : polymorphic base C or T
  misc_binding 1481..1500: 99-15253-382.mis1,
  misc_binding 1502..1520: 99-15253-382.mis2, complement
  primer_bind 1120..1138: upstream amplification primer
  primer_bind 1578..1596: downstream amplification primer, complement
  misc_binding 1489..1513: 99-15253-382  probe
atggagtaaagattgaaggttggaaatggaggcaacattctctgatatgcttttccctgatataatatttgacatacaatcaatacaaacattttgctgatacaataatagctagagatattattatgtctttgtaacagagagatgtttaatatgaaataaatgatgcatagtagatagcttaatttgcttggtggcgaaaaacactgcctaaatcctttggggctgaaatttgctgatttcaaaatgtatgccaatcacttaaaccattttaaaatttcccttttcttataataaattacaattattaaaatatcacccataagaattgaaaatcaaataaatttttgaattatacttcatgtattcttataaagaaatggaatcaggaatatgtttcaaaaagatctttgtcaattataactatcattgtattactagggtttcattaaaactggattttctctactttttttgtattttggttaatgagttatttgtgatttattctatcttaattaattttgccttctttttaaatatatctggaaatttaagagtgtaaaaagtgacaattaaaaatctttacataaccaaaagtagatcaaggttacatttcgctaggttggcaataaaattatccatataattacataattcattcccctaaaatattattttggtaagttacttaaaaattttggcacatcttgtgttccttttgaagataaatcatcctatatatttcaatatattttagatttttttctaactccatctttgttttaagaaaaatcaaagtttataaactatgtctatatttacaaaatcactgtgtcagagcatgacttttaatcatctctgcactttaacacaggccttaggatatttacaaaaattggagaatcaaaattagagagttgcaaacacccttgaaatccatctagtccagtcatctagctctccacttcttagtaccacaggctaaggagacagactgagcagtcaaggtaacaagcccctctaccctttctttgtacaaaacaatttcagtgtttttgaagtatttgtaacaatgttcttagcaacttcattataccatttaacaagaatacattgaaaatcaattccccaacactcattttgtacgctaattttgtaagatcctgaaaagtttcactattttatggtttcatgtgttacagatgaaaaaaaaactagaattcaaattttctgagtttttttttacaatattttatgattacaaagttagaagactaagaataaaatggcctaatttccataatgtgagtggtaaatgcagagcactggcctaaagaaaatatttcaaaaaattagtcatcttttccttaatttttttccaacctatgatctgttgaatgagcattttgcatatataaataaataaattactttgtaaataatcttgactggtttctgttgaccacagtaacccactgcacagcacagcctgtaattyctatgaacctagggaaatgtatttaagtttattttttgattacacaggtcctcattgtgtaactaaacattgcatagaatatgccagtgatgatggagaaaagctgtcaaaatcaatatttaggggagaggtagctgctggcagctctgacacattgaaaaagttcagtgactcaagtacaaagacaggagaaaatcattcaacaaaacccctgaaatgtgtacttgtttttcctgacctacacattttaattccaaaaagagtgggaggcacataattatttttgtcaacatagattcatcaaacacagggcaaatatattcagaacaatggagatatttccttcctgccaattcaagaattattaatttgcctgaggaaaacgtttacatttatgatggtatatacacatgtctacacacacatatgcatatgtaaaagaaaagcgtatcaaaatctaactgtgccggaaagtaggacacaagtgttagctgcattcacaatgacattgcagtgacctcatagcttgctttgccacagtttgctgcctttttcattgttgttcaaaggaagataaatttcaatatttcccttgcttgcataacatggtgtcgcattccagactgttggtagtgtttccacatataaattattggtctagcacttcacagaatctggtacgctgctattttcagcagtctatgcttcctcccagcctcctccttggtggtatgactgttacagaaacattagagggaacagaaatgctgccagtgcacaatgtgagtggtattatgaggaatcagattgctaaaagcatgcatatttgatgaagcaagctaaacaaggttatactgtttaatagcctaaaaaggcaaataataatatatgagaaatcatttctatatctgtaggtgtaagaacccaaagttagaaaaaaacatcttttgtcgggattaaggaaatttattcaatgacatcatagcaaataaaatcagatttttttatgtgagtaaactattaatgcatagcagaattaataatcttgtagcaatgataccaaattaattttatgttttaagcctatgatataagttagtttccaaggacaaagcagtgtgactaaagccctctgtaaaatatcatttcctaaataataacaatacacctgtttgtttttacacttttaaaatttttacctctctgaataattgagaatttgaaatcatcacacaaggaaagcaatatgctttttatttgcatatagcatgttcttttcattaaaaatgtaatatggtgagaggtaaacaaatctgcccaaaaaaagtgtgcaaacctgccagcctaagtggtacttcttcttaaaaattgtactgattttatttaacaaaaagttcaagtgataattctaaataaatagaattgcattgtggaacatatgttatcacattaatcatttgctcctactgctatttcatacttggtggtcattcttatgcc

SEQ ID NO: 120 - DNA, 3001 bp, Homo Sapiens
  allele 1501: 99-15256-392 : polymorphic base C or T
  misc_binding 1481..1500: 99-15256-392.mis1,
  misc_binding 1502..1520: 99-15256-392.mis2, complement
  primer_bind 1110..1127: upstream amplification primer
  primer_bind 1548..1565: downstream amplification primer, complement
  misc_binding 1489..1513: 99-15256-392  probe
  misc_feature 1719: n=a, g, c or t
aaatattaatataagctattaaacaaagggcagaaacatctactaaaaagtttatcctacataagaagtgcttagagcaaagatacaattataaataagaaggtacttaagactgtgagtactttttaaataactcaaaagctgacacagttgagcaactcatttgtatatttgagagcatctgataaattaaaaagtatcattatatgttaaatatgtagatggctggaaatatatatgtgtatatatatatataggtatataaagtatgcaaatatcagcatgatatatttcctaagcaaaaactaaaacttcattaagattttcaggaaaatgttactgagtatcttccatattcccttttcactaaaacataagatattttccattatataataccaagtgcatatcttaaatattatacatctcaactgcattaatctaatttcacatggctatacagaaatacacgagactgggtaatttatgaaagagagctttgattgactcacagttctgcagtgctggagaggcctcgggaaacttagaatcataacagaagaaaagcaggagagatggagtgcaagcaagagaaaggccagatgcttataaaactatcagatctcctgagactcactccctgtcatgagaacagcatgggggaaaagtcctccataatccaatcacctcccatcaggcttctcccttgacacatggtgattacaattcaaaatgagattgtgtggggacacagagccataccataccaccaactcacattctacagctttcaattttctgacaattaaatatattattttagtctgggaatatttgacacgctttgttactacagagcattaagagacagagtcttcattataaatgttagaatatagttgacttgtttccataactactgtttgaatctgactttagagacacgttctttcaaatgcatgcatttgcatatactggaggatgggaagtatttggtacaagagtataagcctagaaatgaatcaaagataggagtaaatttgggataattcaccagcacttctggtcaatggcttctgaaaacaaaaagataattatttttatatgtgcctctctatgatgcttcctattaagcaattggggaaatgtaataaacaagggttggtgagcatcttccttagtgagatgtttttggaagaattggataattgagtgaataatagtgagaaactcctgtgtctgatgttgctccatgttggaatgcttttatgttctcagagaatgagtcactgagagccaattgtgatgatacacaatggttttacccaggttggatatggtcctctgtactggtaccctttaagtcagtggcactaatcagtcagtcattgtcatgctttgtgttggtccatcatatggtatgccctcttagagaacatcctgattagtccttagacatcttttcaatttgaacactggggctcctcattcgggtaaaaaytatggacagtcagtgaaactgttgcaatggcccctcatagcagattggatctcaatgcactttgtttacatttatttcctagctacaaatgtacacatgattccaagcaatttctatatcattataactaaaataaacagttgataattaaaccaaaaatgccttaatagctgcttgtctatataatgtcaataacttgtttcaccacatatgctaanttttttgtgaatgtagtagcatattgatatgacaacaatgtgctaaaaaatagaactttacaatagataataatgcaatattatttaataaaactacatgttagcttaagtatccagttatcacaagacacttagaccatctatatagctatcactatagaacagtttcctaacaacaaataataacccatcaagcaattttctcatgtccacaagcaattttacttatttacagcaaatggaaaaatgatggttgaagcccatacaaaggttcaaatacaatagtacttgctaaactttgtggggacatggaagtattatctgtaagatgctatgttatccaaaagcgtgtgtgtatctgtgtgttgcatatacatgagtatatgagtgtgcatgtgtgtttacacctgtctttcaaaacccttagaattctgatctccattttgaaatgtgtaacttttctaaacatgtgggctaatgggttcttcctatgaaaatgtcattgtcataattaattgatagctataacctgccatggagaagcatataatttgtaatgggaaaatcttcgatagagaccaattagtactaaggcaaatgagaagtactttcacaatcaaaatgccatcaagggttaccttatgtctctgtcctatttttatgggtcttttaatgccatatacactcacacacattattattaagagagttatatttcattaagaacagtttacataattcaggcttattcatatttaactatctgtaaccagtagtaatttttaagaacaatacacatgattaaaatagtgatattataattatgaacttttatgaaactacattttacttaaactttgtgcaaaatacatttaagaaaaatttccatagagccaaacttgattattaagatgtcagaaaatatagagaaaataatgaggggaaaaatatagtgacagatacaagaaatagaaaaaagcataatgtctttactatttcatctcataaaataatctatattaactagaaaccttatgtttgtttttcttttcattttatttcaccggttgaagttaagcacattcgttgtgaattatgtaatgagttacagtcaatggtttttaatagaaaaaaatcatgcagagaaatgtaaccaaaaaatgaattgagagtgacatttagtccaacataaagaaaatttttaaaggaaaaaatggttagctttaccttaatattttcataaattagtactggttaatttttcacaaatatgtacctaatt

SEQ ID NO: 121 - DNA, 3001 bp, Homo Sapiens
  allele 1501: 99-15258-337 : polymorphic base G or T
  misc_binding 1481..1500: 99-15258-337.mis1,
  misc_binding 1502..1520: 99-15258-337.mis2, complement
  primer_bind 1165..1183: upstream amplification primer
  primer_bind 1685..1705: downstream amplification primer, complement
  misc_binding 1489..1513: 99-15258-337  probe
ttataatgggattgctgggccaaatggtatttctagttctagatccttgaggaatgggagtttcatcttttgcattttatggccgattttgagttaattcttgtgaagcatgtaaagtcttgacttagattctttttatttgttttttctttgttgttgttgttgctttttgcatgtggacgtacagctgctgcagatccatttgttgacatctatctttactgcatggtattgtctttattttgtcagagatgtattgactatatttttgtgtgtctgtttctggcctctctattctgttccattgatctatttgtacattctttcaccaatactacactctcttgattattgtccctttattataagtattgagtcttgaagttagtgtcagaactccaagtttgtttgttgtattgttatgctttttatatagcatggaggaaaaaatacttaatataaaaatataaatagtgactgaaattcaatatgatagaaggtgagtgaagaataaaggaaaaatggaagccgtgacaggtagagagggaggcaaatggccaaccctcaattaggagatatttagatgtgaagatcttacagagggacagaaagctgaagcctagagaccaaaggaaagaaggcaatttaattatcctgctgaaggcaggtagttctttgttgttgctattgtttgcagacaagggagtgcaaagttaataaatactaagagatagaaagtagaccttaaggaaatgagagaaaaaatggtagaggaaaggcagagtatacaaaagaaagaaagaacctaggaagtccactgactttctccaaaagataagaggcatcagctcccttcttaccattttttgcctcatgaacagttagttttgtccttattcagtcattttgtcaagttctggattttcttctctgcatttactgaatatggtggaaactgctggtgctccatcaagccactagagggaattccttttcttctgcaagcccttcctccccttatcacaagctccagttacagaggtctcctgcattcttcaggatttgtattctggtcatgctccatgaggaagacagacaagtacaatatagctctgtgattctttccaatatcttctcattatttccagcaaccattgaggtttccagtaaagaaggacttaggaaatattttttgaatcatgagctgctaatagatcagtaaataggatttattaaacacagctgtattcaggactctgacctgtgtgggccttagggaaatacaaaatttacaaactgatgtgattttcttaccagtaagaaatcttatgaaagattaaattaaaaaaatataaatgggggcaactcaatcacataaaagtaatatattccatgtgactgaaatactagggaaaatttagaagtagaatttaagtgagaatttcaagcagggttctgaaagattctacaggatgaaggaagaattgcccatatgccaatkgcctatgtgaaatcacaaaaacagaaatcaataaggcatgtatggaagtacagagtgattgcctagttagaaaaagagcgtgaagggatcagttaacacaaacaagaagagtttaatgcttatctgcaataagttggtagagcaaaattaagcacttcccagtatactgatagacgttaatttccactctaccatgtgaaattttgcaactatgagcaagctatttaatattctgtaacttggttttcttatacataaaatgcagttagtaataactaactcatgaatgattaaatgggctaatgtatttaaagaaattagaataatgcttgcagtattataaatgttcagtaaatattagcattgttgttaatcatctctaaccttcagcctgggatcttctacatacattcttactcacatctaatgaatataaaatgttgcatcaaaatgactgttctaaaattaaacggttttctcatgtcgcaattgcacagaattcttcaatggctctctaataccatcaatcctagaatgttatccagaaatcctttccaatttggtttttgccaagttttctagtttcatcgtataatagttgtctttttattacttgcagttaagttgaactgcaggcattacaaattacttgcatatagtcagccaaaacaagatccttcttctctcccttcctttgcccatcagagactgtatttataattctgacttacacacatctcctcattgaggtgagcagttccccatcattttaaatttagttaaatgacatttatttagcatagcttctttcaccagaatgtagagttgaaggctttcttctctgtccactcagttcattttttagataagtatgcacctgcactgaagtcattgaaattagtgtgtgcttgattatttgtcagtccatgatccattctatgcatgacactgtggatatcaaaaatttgcaaacaatatcttcttttccttatcttcaaaaggaagatgcaggttgaaacatagtatgtatctaaagaagatttttgaaagactaactaaaaaaaataataacaaatgttcaaagtctatctaaattggtgtttcttcacatctgactgtatatgtggaataccttcaataatgtcatgtagatataaggagaagagtatgtgtgtaaataattttactgtaaatcatattaggtagtaagtgttacagtagatgcatggcaatggagtatttttcatctgaagaatctgggaagaacttgttactttgtggaataagactttttttttttaattctaatttgattagatacatataacccagaagagctgtggttttatgtttaagaaagtagagaatccagaagagaaatcatacagttttcagaccacaagaaagactgattgagtaacattatcaaatataccaacatcagtttggaaatattccaaatcatcagattgtgggtaagctgttcagtaacatcattca

SEQ ID NO: 122 - DNA, 3001 bp, Homo Sapiens
  allele 1501: 99-15261-202 : polymorphic base A or G
  misc_binding 1482..1500: 99-15261-202.mis1
  misc_binding 1502..1521: 99-15261-202.mis2,  complement
  primer_bind 1302..1320: upstream amplification primer
  primer_bind 1782..1802: downstream amplification primer, complement
  misc_binding 1489..1513: 99-15261-202  probe
tgtatgtcaagtgaaatatgggattctgcttgatttaatttttgagattcaatgcgataatttgtattcattaaaataccaagaaagccttgagtatgattgcttgcaagatatgttagaaatcactaagcaatgtgaaaatataagcagatgaattacctattaaatctaataatttccccagaaacagattttgacagagttctgacttttaagagaaccatattattactttgcctagtgtaactgtcaaatgcatgtacaattatgaaataattcacaatgttctttcaaatgcagctttcccattagcttatatttttaacttatataagttgggtttttttttccgtaaacgaagccaaaatatttctcctgggaaatacttccattatgtaatttaattgttacatttacattgtattactgtctgataaataggccttttcattgataaatcaaatttacagagacaaatgtatagcaatagtaataagaacattttagtgtaacatattctctgcttaaagcactcacaagatgatattctcaacatatattctactgcttatctcttacttccacggcatcttcatttggacctactgtgtttgaaatgttccagtcattatccagaatagcattcctaaaaagaaatacaattatttaattggttagctatataaacggatcagtcatttcaacaatacatatatccaagtcgcatttctctagtcttcatacctataaagctgcagaatgatctcccgccttggcccactgaagatggtctctttcttcatgtcttcaagcagcaggtgccagtgaatggatatctggtatgagtaatccagttttaaagcacattttactgaaaggtttcctatttgttttaataaataatgccaaagatatggttatctactgtggtataacagaccaccccaacatttagtgacttaaaataataattattttttgtgtccccaaatctgtactttgtgtagggcttggcaggaatggctcatctctgttccacaaggcatcgactggggtggcttggcagggaccggcattttcatttccaaggcagctccccgacacggctgattagtgctggctggcagtgtgttgagatctcaactgcggctgtcattgggggccactctgagggaggcccctggattttttacagttaaataagttttatactacatcacttcatttctttttccagaaacactggcagctaagctgcattttatttgttggtttcttcaataataaatatttcactatttcttctaatcctttgtttccacttattttatttcattcctcattttatcccttttttctaaattccattttattatacttaaggtgcttttaatatggttatcatactcctgatagtgttatttctttcttagtcttcttatataagcgctatacgttcacattccatctcctttggttatctttccatttcttcaccgarcctctttgctctctttttttatagctggttcactcaaaatgtcttactttgccatttttgaaatttattttcattcttttatgtactgaataaaatttaaaaatactttatcatggtgggaggtacccgtgatgtccaaataagtgtttatattaattgttggggtttttttgtttgtgtgttttttgaaaggttaagaaaatctcattcagaaagtaagttgtttaaaaattctggaccaaatttaccacacatcaagcagatacttaccaagttgtttggtagacattagcagtatttactaatgtctgcttctccttgtaagcaaatgtatatctatatttacccctgttactaggaaagaaatcttgtctttggcagtggaaaacccatggagggtttaccggtttctctctgtacccttgttgcaatgatatggtaagcagagttgtgataaattggtttggtcaaacaaaattagaggtatctggcttgcggagaacagctgctttgccatatggtctgagacccacagcagttctgtgtacatgggaaataaacttttattgtattatgtctatgagaatgtgggtttgttttttactgtatcatgattaatagagatgggttaataatttttatactatttctttttcctttgaccattaagaattccatgtgactatgagaatttgcaatacagtgccactctcctttgctttcattgatctacgaaaacatgaaaagctataatctttagaattagtacatccagaacttttcctgtctctattcctatctctttaattgatattccaggctctcatgagtccttgcagttaatccttttcatctttgttatttatatttcttcaaactaaaggctgtattcaatggcaaatctatgcttggttaaagacggagaagaggaatagaggtgagtctgacttgggagatcctttccatgctccccctgattatggtaccaaagttgcagcacgtctttcaacagctcctttgcattgatattttgggaaacaattatttgttctgccttcttcctgcccagtgatatatttacacaggttggtgatgacttgccaatatatttctgctgtagttaaattaatttatctctaactttttttaatcttagtgatttcctaaatttcctgttgttacaattttgaatatgtgatttttatgggaatagcagctttatcaactaaaatataagaaagttaaatgaagagcagctaactactatcataaactaaaaatattaatataagctattaaacaaagggcagaaacatctactaaaaagtttatcctacataagaagtgcttagagcaaagatacaattataaataagaaggtacttaagactgtgagtactttttaaataactcaaaagctgacacagttgagcaactcatttgtatatttgagagcatctgataaattaaaaagtatcattatatgttaaatatgtagat

SEQ ID NO: 123 - DNA, 3001 bp, Homo Sapiens
  allele 1501: 99-15280-432 : polymorphic base C or T
  misc_binding 1481..1500: 99-15280-432.mis1,
  misc_binding 1502..1520: 99-15280-432.mis2, complement
  primer_bind 1070..1087: upstream amplification primer
  primer_bind 1590..1610: downstream amplification primer, complement
  misc_binding 1489..1513: 99-15280-432  probe
  misc_feature 170,2706..2707,2715..2716: n=a, g, c or t
ctagatgcatgacagatattaccctttatcaccttgtaaacaaatacggttgcccttgctagataacactaatatgtttaagatcttccagctaattcttggtgcttctgggcaccttgtcttcatctccatagtgggaatagtaatatttgcattgcaggagcattttnaaggctcgagattatagttttcacacttatttcctcataaaagcttatcctgcactctttctcatttcagtaaatgacaactgcattcttccatttccttggattaaaacccttagagacaactttaatagatctttgtcctacactgaacgactaatctattgacaaatctttttagctctaccttcataaagtgtttataatatttctacttctcaccactattacagctattgtgttagtttaaggccatgctttgctcacccagatgacagaactaattccttgttagttttaccaactttaactccttgtttctgctcttgtcaccacatcctgcccatacacaatcagttaccatcctcatagacacagtggtctgtaaaaatgcacatccattcttgccacttctgtgctccaaaccccccaatggctaagacaaaatgttgccagtgcccccttctcttttcactccctctctcaacactccttatttcaggccctacaggtaactgctattctaaacacctgtagctcctttcctagggatttcctctggctctaggaacaatactggatgagtagttaaggtagaagtacagaaatattcaatgccctgggagcatccatcaaccatggacagaagaaagtggtggataagtattccagtattcgcagccctcaggtcaagacactctgaagtatgtgatgtatcatccccaaagggtcctgacagggtataattctagttgctctgggcaacctgcttatgaatgaactctgtatttgttctcttcctctccctgtctcactttaccactttagtcctggtatttgctagaatattctcccaaataaactacttagcctctaatccttgtctcagacattgcttcaagatgtccatccatcttgcccagagagagtttctacaacacttcctctgcaagccctttccctacttgcctcacctattgctttcctctgttacattgtattcccctcactgtttcttccaacatcttcccacctcagagcatggacacttgctgctctttctgtgtcatgatgctgctcacttgtccctttcttaatgtctcctccctgagccaatcttctccacccccacaacttacgcacacttacatgtcatattttccttcatagcctttaacaccatttgaaatgatatatatttgattgcttttaaaatttctctgtccccccactaaatataaacttcaggatggcaagaatgtagtccattatcttatttctccagcctccatacttttaagaaaataaattttggttgtataagccatccagtyagtggtacttggttatagcacccctagcaaaagaatacaaaaaaagggagaatgtttgcaatcatctgtttgaggctaggaattcccagagagggaaacaaggagtaatcgtggaactcaactacttaattcagattcagtgcagtgaagatgaaaaccagctttcacctaagtaaggagattgacatcataatgagattgacatcataatgagattaagtcccttcactccagaaagtgaggccctaatacagaattcaaaggtaaaattgctcaacacaaaacctgggtgtgttaagaataggtattttatatttcccacatggaaatctagaagtaagatcacagaaactattctttttagttttatcagttttcttttttattcaaggaaaacatggtaaaaagtatactctcaaccaactatcttggcaatattacactgacttataatttaaataatatgtcagtgtgtttcttttgtagtacatactttaacaaatacgttttcaaatttttctaagagtcattttgaatgacctgaagtgtaggatgttgacattgttttgagtatgttgatggcatcctattgcataaaaaaaaaatgtggtcttcgatgaattctaaagtgacatactgtagttaaatataaaagcaaagatataaagaaattataaaaacttaagttattaggttgatataaattgattagtaaacttaaatagagactcaaattgtatgtgtgtttactctttgcatagactgaattctaatcctaatcacttgtatagatatacaaatgtatatgaggtttcataaaatcctcattctcatgactacaaagactttgtagataattctggttgtttgctcagcaaagaaatgtttgattcgggaaaaactttttcaaaaaatgttattcacattggctaaaatatctaagccaaagtgttctgcacttgaccttagaagctcatctttctgaaatagttctattttgtctaattacctcctgttacattagataagtttcttcatgctggtctaaagagttcttctagcctgctggtatttgcacatggcatttaagtatttgcaagagtacttgcccctgttctttactcatcagtttgcaatgtcaatcatcacttagtctcagattctgcaaaaattatgaagcaaatactagttagttttttggagcnntttttttnnttttttttttttttttaatatagtctccctttgtcacccaggctggagtgcagtggcacgatcttggctcatggcaacctttgcctcctgggttcaagtgttcaagcgattctcctgattcaacctcctgtagctgggattacaggtgtgcgctaccatgccgggctaagttttttgtggttttaatggagaccaggtgtcaccattttggccaggctggtctcaaactcctgatctcaagcaatctgcctgcctcgccctcccaaagtgctaggattgaagacg

SEQ ID NO: 124 - DNA, 3001 bp, Homo Sapiens
  allele 1501: 99-15355-150 : polymorphic base C or T
  misc_binding 1482..1500: 99-15355-150.mis1
  misc_binding 1502..1521: 99-15355-150.mis2,  complement
  primer_bind 1352..1369: upstream amplification primer
  primer_bind 1822..1840: downstream amplification primer, complement
  misc_binding 1489..1513: 99-15355-150  probe
attttggtatttctcttaagtcataccactagagtctgagaagggtaaaatgaattgtaaaaaatgtttctaccaagattaatcaattaactggattgtcaaaatatcactgctttctctattttatttgaaaaaatagtgtttgatatataataactgttaattattatgcatagtaattgttaaataaaagtttgccatgttatcacgttctcttaaatgactgagttttaagctattattccggaaaaccaagtttgagattctaaggaaacattctgtcataggagccgtactcattgccttcaagacagacctatttcaatactgtcaggatgtgcacacacatgcttgtgttctgtgtgtgatggacacatattattataggtgttctacaagaaaaatccttgaagggttttatgggttctctaattaataaaaagaaaaaaaaaagccaaaaggatgagatggcagtaaggaatgtagggttaaggaaaacttgaaattccacatgaagtgaatgcctatggaaaagggacatttgttcactcggaatgagactgcctacttactcagtatcatagaattaaagaaaaaaaatgagaataggtgtgaagactgtaattacattttcattattatgttacatgcttaggatataggatggaattgccaaggtcattagaccaccttcacagccttcaaaaggaccatacatcatcttgttagggcagagggctgtctgccttaatcacagtttgaaaggtaagactacttcacctctgccttagtaaggatatttatatctttgttgaaatagacatcttgccttaaacttatctaaatctcccttgctccatttcaataggttgctaactagttctatttagtttggaatgtatgtgtattccatttgattgaagaaagttgaaaatgcatacgactatttatcacacactaagaacttcctggtatcttggatgtggaatgagaaatcaaaaatttatgaccccaactttgtcatgtactcactgcataacattgaccaaattacctatcctctctaagccgtaacttctacatcactagtacatttcatgaagttgtgagagtcaaatacaatgatttatatgaaggacttagtaattaaacaagagacatcatatttagaagtcagtcatttttaatatagtaaacaccttcagtcaatagatgctttctaccattctttttaaataatttaaaataacattgtacaggattgacttttcatgccaggctttgtttctgcaatgtggtaattcatattaatgattcattttcctgatttcaaaatatgaaatttatcttttaacttctccgtctctccttcttagcccatatgtcaataatgactgaaagtaatcatttccatctttaaactgcctattccagccccctcccacctccatctctttccttctaagttttcttcatcttctactttgggcaaaaggaaatygatgtgtcagacaggcctagttttgaattctggatctgctagcacttctctgtgtgtccttggttatatgatatagtcttaaaccttaatgttcttgcctgtaaaatggggataataaaaacctcttaacagtggttgtttcatgcagctttcattacaaacttcctcattcaaaatcttcaatgatttccatttttcacaaaatgaaattcaaaatttctgtagattattgagacaagtcccctactcttcacctaaatttatcttttatttattctctcatcattatcaacaactactaggctttgttgccttgactccagaggcaaaaatcttatctcccaacaatgtctcttaagttaagtgtaattcattatttgatattcttgtttcaaaatgggtagaggaaaacttcctgcatataccgtaaaataattttagggaaaatatactaatgtatgttccagagcactggaaggtccaaagctacctatttgcattgtaccattactatttgatgtagccttttgctcattatgcaatgagctgaaatacatttttcatcatgcctcctgagtctctaagtaagagtgattgactcattccttttctaccagtgagattgcaaagcaaaaagaaatatgtagtatttatttactcatggaattcattcttatgaaggtcagttgccaaatgatgccaaaaccttactttctagaatgctattcaagttatcaggctttaacgttttcaagatgtttatgtttgacaaccatatataacataaaattatgtgaagtaaagtataacataactgtttcttttctatgaaacatgcctatttcaagtacatagtacactgcactgcagataaccggctgataaccagctctcaacacatacaacctaatgattgaattaaaccatagtgtatatttttctaaatgtattcttaattaatcacattacaaccatcagtatttgggtgaacagcttcagcatccattagtttttgagcaaagaactagaattcggagcattcaaatgatactagagaaaagacatgaagactgtttatgagattggtccatctctgagaaatgtcaagatttaagaagagccgcaatttcaaaaccagggctacttcattgtggacctgaatctatttacccagggtcaaatcaaggatttggaacagaccatgggaacacaccactttcaatttttgaaatatttgcaaatacatgatgagatatcttggggatggaacccaagtctaaacagaaaatcaatgtatgtttcgtatctaccttatagacatagtctgaaggtaattttagataatatttttaatattttgtttgacaccaacattattcctgtctctgaatttatatgctacacataagcaatcattttattatacctattcacatgtaagtacttaacagttaaaaattgacataccattcatgcaataaaaaataatatgctgaaggt

SEQ ID NO: 125 - DNA, 1887 bp, Homo Sapiens
  allele 1126: 99-25224-189 : polymorphic base A or G
  misc_binding 1107..1125: 99-25224-189.mis1
  misc_binding 1127..1146: 99-25224-189.mis2,  complement
  primer_bind 937..955: upstream amplification primer
  primer_bind 1446..1466: downstream amplification primer, complement
  misc_binding 1114..1138: 99-25224-189  probe
  misc_feature 1114,1877: n=a, g, c or t
aaattattttgaatgcctgaatggacatgctattcaaatgttttgagcattgtaagctctataattgtttaataaaaagaagatactttaaaacagtactgagcagcttttgtttctcagtaaaaagaaaaacattccaaatatgatcttacaaatggtactaaaaacataagtacttttctagcttcttattacgtatagactgattagaacgttcagaaaatgcaatgagcaaaaccaggctatttcatttttatttatgcctattcctactcttactcaactacacgttctcagtaaaagaagctacctatcaatcactcagaacccaaagttacctcttgccatttcttgagaaggttagaaaacacaacatgaactggattttactgaaacttcactttgaaacaaaatagaatgttttatgcttttatttatcaagaccactgaggaaattctgatccaagaaaactttagggcaaattttgaagccagttcttcaatagacaaaaatttgtcttatttactatggctcttaaacataagcaagccaaaactaaaatcatatactcttcttttaaaaaattaattaatattaaataaatttactgctttgatttaaacagtccattcactgtttcatcacccaggctggactgcagtgttgtgttcacagctcacttcagcctcaacctcctgggttcacacagtcctcccacttcagcctctggagtagctgggactataggcgtgtgccaccatgccccaataatctttttacttttatttttgtagaaacgtggtctcactatgttgtccgggctgatctcaaactcctaggctcgagtgatccttccatctcagcctcccaaagcactttgattataggaatgagccatcacacccagccaaaaccatgttttattatgaacaaatcagataatccaagtttaccaacctcatcaagaatcaacacagtgttctgaataagattgtatgcaattctttttgaacatttggaaaatgctaagtttagtgcctgttagaaatcctaagatttttagagggatatctgatagtttcaatagaaatgaacaaatgaaataaaaattcnttgacttaaggrttttgaaacatgcacagtattgaaggacttaattattctagtagaatttcaggcattgtttatgtgttctgttgtttcctggttaagatctatttttttcactttacgatcccaattattatatggtaagcttttgagtcttggggacatcatagttctatgaaaagggatataagaagatagtttctacctttatcatgagcctaaaggtatgtatagataacccaatccctccacttactttagacctgccaaaagctcacattcatcctggttgctccatatgtgtgcccactcagacaggtacatgctcacctatgggaaagttgtaaaagcacacacggtgtttgctggatcataggagctccacatccctccagacacttgtcggtggtagaattgtgtccccccagcaaaatatgttgaggtcctaactcccagaatctgttaatgtgaccttatttggaaataaggccttcacagatgattaagatgaggtcattagggtgggcgctaatccagtgtgactggtgtctgatataaggagaggagaatgccccgcgacgaggacacacaggagaatgccaagtgacaacagtggtataaattggagtcatgcagctgcaaatcaagagatgtcaccgattgcctgatacctccaaagtcaggaggaggcaagcgaagatgccactctacaggtttcagaggaagcatggtcctgacaccaccttgatttcagactgttctcctncagcactgtt

SEQ ID NO: 126 - DNA, 3001 bp, Homo Sapiens
  allele 1501: 99-25950-121 : polymorphic base G or C
  misc_binding 1482..1500: 99-25950-121.mis1
  misc_binding 1502..1521: 99-25950-121.mis2,  complement
  primer_bind 1381..1399: upstream amplification primer
  primer_bind 1859..1879: downstream amplification primer, complement
  misc_binding 1489..1513: 99-25950-121  probe
ccatcccatcttcatttatttcagagtaaagttatctaaatgaacctattttctaattaagaatttcttttatggccagtaaattactttcaagatttgccctgtaactctgcagaatgccaccagcatactatgtcttgaggataatagagaaaatttctatattcataaaagaatgttttctgtccagaattgcttttgattaatatgaggctgcattactgacactgcctttttctgggaaagaaccctgagtgtattttatctaagtgccattattgttctggaaataagatagcaatggcattcgttagctttgactctaatggctgtaaaagctatgggaatgtaggactttgtgctacgtttgcatgagataatgacggctcattgcaggccagctttcatgaacttcatttgtgccagaacggtaatgctgggcgtgtacttagggcttttcctctcgaaggctccacatatcacttttgaacgtgtctgtcaaagtagctggtagaatcaatgaaaatagccttggcctccagcatgaatgatctaaattgaaagaagcatattgagagggctggaacccagtcacaaattcagggacaggcggccggataatgaagcaaaggcacccagtggcacagctgtgtcgcatgcctctgggagctagaggggagcttcgccatcatttgtcttccatttgcacacccagagagctgtgtttattgggggcttgtgatcccctcttcttttttcaaccacccaggggcatctgctcataaagtgtgtaattatttatttttacaattctgcattatccagataatattttgaaatctggactgatttttgaaaaatcaaaaaactgctttttctgcattgttcaaaattgactttgagaaatcgactagcagttgtgaattgtttcagttcatatcctacgtagctagaagttataaagctattcttaaatatgatgcctagagaggggtttggtagatggggagtcaatgcacaatggcattaagaaaggtggaaagaatgaaaggttgctaggaatttaataggcttaaatactttcctttcacccttctccagtatggagaggtgaggtttggactgtagacgaacaggtaagcacaaagtaatgactggaggaggtttctcagtagaagccaaggaagacctggtgccagggttcaggtaaattctaactcagaagatgtgagttttcagtcaagattgacctgttgctcaagatacaaattgcagtatttgaattttgtataaagataatacatagggtcttttcactgaagaatcgtaaagctttcaaatattaaaggactataaaattaaattatatgccattatttactaccaaatcatcaactaccaaatacctcagtgcattttctagcattaactttatttagtaccagaattatcacagagtctaaagttatttcacacttaattttgtagaaataaatagatstgtagaaatcttccttatggattcaatattttgggaaagaagcctcagtgatggatattttgttgtgttagaagtggctatctattgttactttgtaataaattatcttaaagggtgtttattgtaagtatcacatataatccaggatattttcctttggaagaggcaaacccagttaaattgggaaaaagaatatagtctgcaaatacaaacattgaaaaatgtgacctctgccccttttcaactcttataggacaaattcagaactcaactaaatgaaattctttatattgttaaaaaatttcccctagatctcagacagatgctgagatctgttttgtagcattcacccacgtacctaaatctcactctcagcaattacactacttgaagaatgtaccataagaagagcaaacttaatggagcttgaaggtggtgtcatattgagtgtaggcacgcaacaatataagtgatccttttcttctcttgctttttttcttagttgagtaaaaataggttagtgggcatcatctcagatattccaaatcatagctaagttatttatttgcatagcatcggatcattttttataatatctgatatgaattaagcaactatattttatttaaaataataatagtaactaccatttatcaagtatcaactctgaactatgaactttgcattcaaagacacagatcaggtcatggagtttttgatgtagatattatcacacttttatagatgagaaaattgaggcccgaagagtctaagtaacttggccaatatagcaaaggacaaatcaagaatttgaacccagtcctttagatcctggtgtccatagcaatatatctcacatcttgttaattgtagtactgataagatttcagttattacagcatttctcagagatcaattgcacatatatttaaatattcaaaataaaaattctaaatgtctttagatgtgtttgtaaagaagatgttagtttttcttgtgggatctctacagtttcagtgctcttggacacacacttgcaaattccataaatcatcactagataataaaactagctaaagtgtattaaacatctatgatatgccgggttcagagaaagttatttttatgtattgtttaattcacagaaaaaccctaccatgtaggtgaatatgttattttcagcagcagcatcttatcaatgacaaaactcaggaaaagagaatcaaaatgatttttctagagttatacagcaagatagtggctatattattcattctcatcctgctaataaagacataccatgactgggtaatttatgaaggaaagaggtttaatgattcacagttctgcatggctggggaggcctcaggacacttacaatcatggcagaacatgtccttcttcacatggcagcagcaaggagaagtgcagagtgaaggtggggaaaagccccttataaaaccatcaggtctcctgagaactcattcactatcacgagaa

SEQ ID NO: 127 - DNA, 3001 bp, Homo Sapiens
  allele 1501: 99-25961-376 : polymorphic base T or G
  misc_binding 1502..1520: 99-25961-376.mis1, complement
  misc_binding 1481..1500: 99-25961-376.mis2,
  primer_bind 1854..1873: upstream amplification primer, complement
  primer_bind 1391..1411: downstream amplification primer
  misc_binding 1489..1513: 99-25961-376  probe
ctagacgatgagaatctggaatttaggatttgcaatgaaggacttgacagtgatttaatcattctggtcctcaagtcttcaattggaaaaccgatacagcaatgttttccttttatgacagattaaatgagctaatgtttgtagtatgctaaaagtcatgcacagcacctcacgatcacccccttttccttttgtcttttcacttccagtcatatgcagctcaagccacgtttttctctaaaagcttgacttgattgtgttttcctaatttctagttctgtggcacaaaagtggtggacatttggcagacaaataaacagttgatgattggttgactattgcttgctctacagctaagttgaaaataatattcagtaatgtggtttaagaaagtatgcaaaagtcattgtagaaaactgaaaaaagggcaagtaacacatgttgatatctagagatatataaatagaggcaagtgaagcttaagtcatattagactccaacattaggtattggtaggaatttttaaaaaagaaatctcagaaaatataattgcttttcatagggagaattgttatgtgagctcatgtgggctgcttgatatctgatacctgaaatttcctgtcttcggtacctttcctactattttcctttcttcaaaagaaaagccagaatcaaggttgatctcagaggccaggcagtcctcacctgagttgggcaccagccacatggcaactgacaagtggtgttgcaacattctatgcaatgggtgaattatgaaatttattttgaacagcaaacatttatttcagtcaattgactttaattaaatttaatgtcaattaaatttaatgcaatttccattcaatttttctaaagtacaatacggatttttaaaatgatataaaccctaaatttaattaatgtatgtatatctttacttaattaaaatatcattttttaagtagaaatggatgagttctgtaaaagtccgtgttgcttttggaacaagtttttggagttttttttttcttttcttttttgaagtaaaagtagcattttggcaaaaataaaaataacccctaaattcttcgaatgtttgcctgcacattttaaaaagaattccaggcatggcaaagcacattctcccaaaagaggtggggaatgtgctggccagtttcccgttatcattactgggctgtgaaacctacaactttgcctaatacttcatttatgtttccttatttatgactcataaatggtttacttcttatagttcttcccattttgtgaacgtttttaaaagttcatagcatcatctgatcacactgacatttatggcaaataacgaaattccttttaaaactcattaggtgagaaacacagattttcaagccctcagtttaacagaagctaatctcacagtgacctgccatgcccctgccacattcaagggtttacaatgatcgtcttccagagtttgagatataagttgtctgtgtakccccgtcccaggagccacaccaatcctattcctactgcatagtttattttctcggaaatctaagctctgggattcaagcaaagcaagagacttggggaaaggcttctcacaaattcaacaaggaaaccattttcacttggggaggtggtaaggggaagaccatcaggctccaactgcatatagtttcatggacaattatttgaagaaagaatggaagggaaagaaggcagaaagtgacccttccagaccttggtgaggcaggcagaaccctctgagtccaggggtgtgtctgtctttccctccttttccaactgtggaggagaatgtagaacataatttcaaattcatacatgttcccattcacaggggagagaaaggaagacattcaactaataaaggaattatgttttcacaatgagatgaattagaaagctatttttctttaacttcctcctccatagtaacttccaaaatggaatcatttttttttccctccagcaagagctcaacattgtattagatagaaataatgtaagtatcagaaagccatctctaaaataataagaagaatctggaaaacaagctggtagagtagttatttttctttatgttctctatagtctcttcagaactgcattttttaaaaagtgcaaatctcaaaataaaagaaaaataaaacaacattttcattggatgattatgtattcaatcttaaaaatcccagctctcaagagcctctagaaaaggtcaaggaggtctaaatgctcagtagaatggaagaaaccattgctagaagccaaacagagactctggtgacgcaagtgatcttaggagattctccaagtatttcctgaacaatttttaggggccacactcagtgctagatcctggggatgcaaatactaaaagacaaggtgtcaaggagaggtcctgaaaaaatacctggtctattatgactgacaaatatacaatgtaatatacgagaaacagagccataggtgagacacacatgtagagaagtcttgacttacgtgcaattctaactatagaacaaaggagccgtagtcacttttaaggattttaatgctgcgcagtccacacagacaagttgaggttttcatttagtgacacttcctttatttacagaaggctcagtaacactgacccattttttttttctgcagatgattcttaatgctggttagactattaacagctgacttttacatggaatttactgttctaagcacattacttgtattagctcctttactcttacaagctatatgataaattcattttattaaccattttaaaaatgagaaaactgatacacaaagaaactaaatagcgtcacataaagtgacctggccaggtttggagcacagatggacttattaactactactctatggtattttgattcctcaataacttcttaaaaaagctggaagttacttgagcccttcatttatgtcctacacaaaaaataaatgtgcc

SEQ ID NO: 128 - DNA, 3001 bp, Homo Sapiens
  allele 1501: 99-25965-399 : polymorphic base T or C
  misc_binding 1502..1520: 99-25965-399.mis1, complement
  misc_binding 1481..1500: 99-25965-399.mis2,
  primer_bind 1879..1899: upstream amplification primer, complement
  primer_bind 1429..1449: downstream amplification primer
  misc_binding 1489..1513: 99-25965-399  probe
ttatttcacttagcacagtgacctacagtttcatccatgttgctacaaatgacagaattttattcttttcatggctgaataatattccattgtgtatatgtacacattttctttatccattgattcattgatgaacagttaggttgattccatatcttgacaattgtgaacaatgctgcaagagagtacatacatctcttcaaaatactaatttcctttcttcagaatttatacacaacagtgggattgatgaattatgttagatttattttttgttttttttgaggaacctccatactgcttttcctgatggctgcagtacttcacatttccaccaactgtgtaaaatcctttcttaggatcctcaccagtattcattttttgtctttttgatactagtcattctaactggcgtgagatggtatctcactgtggttgtggtttgcatttccatgactcggtgataatgagcaatttttcatctagctgttggccatttgtatgtcttcttttgagaaatgtctattcaggtcttttgcccactttgtaattagattgttttttgctgctgagcactttgaattccttatgcattctgcttataaatcccttgttaaataaaacagttcacaaacattttctcccattctgtgagttgtctctttgttgtgtcctttgccatgcagaagctttttggattgatgtaatccaatttgtgtattttacaatcgttgcctgtgctgttgatgtcttatcccagaaaatcttgccaaaaccagtgtcccataacatttccccagtgttttcttctagtagtttcgtagtttcaggtcttccatttaagcctttcatctattttgaatcattttttgtatatggtgaaagatgggaatccagtttcacttttctgcatatgaatatccagttttcccagcaccatttattacagactgtcctgtccccactgtatatcctcagcacctttgtcaaaaatgaatagcacgtggatttatttctgggctctctatgctatcccattggtctataatttaattagcctgaaaatggaaagttagggagactccttcttctctttctccatgttttcttaatgagaaaatatagaaaaaaataatgcaaagtaagtaccaggatgggggtgtgtagtttcattttaaaatagtaaggttgaacaaaagtttatgccaaaggtatttaaaataataacacaaataatatttaaaggcaaagatgtatatgtatatatacatgaacatatttaatttatataaaggagaatgtgaatacatatgtatgaatttttttacttggtgtatacaatatgaacatatatatatatgcatatgtatttatttacttgatctagaaaacttgactatgaagttctctagtataggcccttagaagttctaaaagtcacagtaacccacattgtacctttggtttttaatgaggaagatgatctgctgtggtgaataaygcattttccttgtgaaagtcacgtgaccagtacgcattgacagaatcatgagacaaattaacaatgagcaaaacttattatctccttacacttcatgttaagttctttgaactttcatcttctctagtagctaaacgttacaatcgagtcagctttctctcagccaattgttttctctatttattctatcatttaaagttactgatttggatcattattttcctttcccatgacatttgacctaggaagttgacaaaggtgagctggcactgaaaagcaacttgacccaggaaagggggctctgcgcttttcttatctaagcatcctcaatcgaaacctcattctttctttccgttatcttggcctcccatttaaagctggtgtatatgtattttgagaatatatcatgtcttccatcacaagatatcattctttttatataagtatgtcttgtcagctctttgcttttctctgatgctggattgtggctacacagtgtgaataatgacacataagcaccctgtttatttaaaaggtttcctgtggttaagtacatgtattatactagagagcaaagaatttctttctaaaattgatttcagtagaccctatgagaggcatcagccagcacccgggaatgagctgccatagatatctttgtttatgctcccacttcagttcttttaagtgcattattaatagtttatgtgactccttaatgtttggtattagtgttttcatacaatgaaagatgataaagtgatgccacttttattgtgtgctttaattgctaattgttaagaaatgtatattgtttccttcaagttcaattcctttgtgacttaatgtcattgctggtcatctttcaactagatcaaattactctcatactgttttatctttttcctttgtctttacactttttttaagggacgtacgtttgtgtatatagataatccaccgttaaccctttattttacatcattatctatggcatttatactttataattattttaaaaacaatgtttataagacaaaatggtattcaatttcaggtaatttagtcttagaatacttattttcttctttctcttttccttctttaaagacaggttctctctctgttgccctggctggagaacactggcgctatcatagctcactggagcctgtaaatcctaaactccagggatcctgccacctgctccctaatagctagaaatgcaggtgatcatacctagtttttcctcccccacctgccaacagacccaagctctctacaggcgtgagccactgcactcagctcagtcttagaatatttcgagtcctgtcgtatgaacttaatcgagtaaggtgaaacgttaggggcagagttttaagttttcattttgaggggtcattaaggctttaagtttaactaaaaaataagtatatattattccctttgggtaatttcctagaaagcttatcaaaatatttatttggtatagatttcaaa

SEQ ID NO: 129 - DNA, 3001 bp, Homo Sapiens
  allele 1501: 99-25966-241 : polymorphic base T or C
  misc_binding 1502..1520: 99-25966-241.mis1, complement
  misc_binding 1481..1500: 99-25966-241.mis2,
  primer_bind 1721..1741: upstream amplification primer, complement
  primer_bind 1219..1239: downstream amplification primer
  misc_binding 1489..1513: 99-25966-241  probe
  misc_feature 1659,1987: n=a, g, c or t
tatttttgtttggaaagtacaaaattttattatttttatttttattttactttaagttctgggatacatgtgcaggattgttatagaggtatacatatgcatggtggtttgctttacgtatcaacccgtcatctatgttttaagccccgcattcattaggtatttctcctaatgctctccctcccgttgcctcccatcccctaacaggccacagtgcgtgatattcccctccctgtgtccatgtgtcctcattgttctactctcacttatgagtgagagcatgcggtgtttggttttctgtttctgtgttagtttgctgaggacgatgggttccagcttcacccatgtccttgaaaggacatgatctcattcttttttatggttgcatagtattccatggtgcacatgttggaaagtacaaattttagttcatgcctgaaatattttcataaaattgggtatcttgtgcagcgaaatgtttcctttttaaattattattatttcattttgaaactaaagaatcagttaagaaaatgaaaggcttcattcatcatgtgatttagcagctgtcaaaattgtaccctttgctgatgtcttagttttatttaaatccatttactagttacggggtaattatttgcccaagagtattacgtattattactttatccaaataatcaaacttcaacctattaggaagataaaaaaactattaaaataatagctgtggcttttttcccttttttgtactataattaaataaaatacatttgctatttttaatgtataattaataacatctatatggaatattataaaaaaacacttactgtatttctttgatgaccattattttataatataaattacgtcttgatgactactgaaattatgagatattgagcaagaggtgttaaggagtgatctacgttggtgtcaaatatgctgggtatgtcactagttccctgttaattaagtatttactggatatggcagacaaaatattgtatgttcataaaatgtttccaggttcttcctatgtccataggaatactccctttcccaggccctgtacatctccaggggctgcgtggctagttgcagtcataaagcttggggagaagcgaggtcatcacttccaagcttcttcccttcatcctctttttgtttgcagctgggtaaatacagaggacctgtgagaggacaccacaatgcccttgagagtcagtgaagatgatgtgcagctgatctcctgccagcctaagatacccttggagcctaagtgagaaacaaatcttcactgggtgaagccactgaaatgtaagggttgatgtgttactgaagcttagcttgcctgacctgaccaatatatctacctctaaataaacaaggcacatggggaatgagggagcaagagcggtaagtgtggactttaagaacagttccgtgctgaagtgggatttgctatgagcttggaggaaggagtggcagtcaaccgacycttgaacattctcaatacatgcctcacactttcataccatcaagcatgactcagatttttcctgaatactgacatgacttttcctatacttaaatatgaatgcccagaagttaaataataccttcttagaaagcctttcctgaactcatactcatacnttttagtctggactcctgtgtcaccttcatctttatgaaacttattttatgtgtttttaatggttggctgtttacactattgtctccctatctagcttttgatttccttaaggttaaagatcatatctttgtatctatgtcccacagcacttaagaaaacatttgtacatgaccatttcatcatttatttacaaacacaaatgtgtattacctatgagtcacagcccgtaatgggtctgaggatcaatacatgtgtgtctaattgaattaagatttgttagggagagatagaaagccatcctgggctgatgaaagctttttgaataanggaggactttgcacaaggacatgcttttccaggaagttcaagtccacttggcgttgtagtggaaagtcaatatagagagaccaggttggtggaaagtcttgggtgccaagctaagtggaaaagacttgagttcttgaagagaaatcaactaagttcaatagtctaaattttggccacagaaaacctatagcaattaaacacataaagcaagtaatttgattctactttattgtagagtacgtgaaaaatgtatggtgtcttatctcaaatcattactcaatgtcagggcagaagtacaattgatcaagcctatagtcagctgctaattcacgagtttttttgtttttgtttttcctgtgacttcctagctttccagactgggcaaaatgatatctgcagacattaaagaatactggaattaaaaacacattaattttccatccattagggtgatgtgtgccccacaggtggactataaggaattccctggcttggtgcctgattgctttgcatagctggggattccacttaacaccctgccatgaccctctgctggtatgcttggctgccttaatcttggtatatttcatgttgaatggccgtggcagtccaagttgctccgtaggaaatataatatgtgcactgtagaaagctatgtcagttttgctggtactgagtggcttcaaattcaaacctagctgttgtaaaaacaacaactaacagacaactgtgattttaattgaacatgctaatatcatggccattttgaaacaatggtcaagtgtaaatattttgaagaaaagggtttcttaaggtaatgtgagtagtttcaaagcataaataatatggcatgtaatttgtatgcaaatatataacagcatgtatctttacaaaattaaaatatttaagaagaacctttatttatgtccataggaatttcattgagaaaatagatcatgatgctttaaaataattatttatctatctatagcacaaacaaaatataaaatttca

SEQ ID NO: 130 - DNA, 3001 bp, Homo Sapiens
  allele 1501: 99-25967-57 : polymorphic base T or C
  misc_binding 1502..1520: 99-25967-57.mis1, complement
  misc_binding 1481..1500: 99-25967-57.mis2,
  primer_bind 1537..1556: upstream amplification primer, complement
  primer_bind 1064..1084: downstream amplification primer
  misc_binding 1489..1513: 99-25967-57  probe
tttgtagactagaatctctttgcttacatctactaaaatatgccaaaagcacacatttatgcactgaatatcagagagaaaaattatctgaagcaacacaccagatacattttcaggtattaatagaaatgttctattagtgtaccatgttcattaaagttttgcacagaacatcaaactatgcattttctaatgagataacatactgaatgaatcatatattacaatataaatgaccattcactaagttaatttattttactctagactttatgacctccttgcaaaactttaaagagggatttgtcaatattcaccatactgatattttaaatagttaaaaatggctcatgaatgaacatgattaaactatcagacagaaatagtaaatgatattatagcttgaatgtcaaactatagctcatgatattttcagttattcactttgtgaaggataatttctattctgacctaattcttttattatttaatatatagtttaatcatataaattatgtaatattaataatatgtatagcctacatatgtcttttttgtcttgatttttaaaataatataaaattatattatctttaacaaagaataaacattttgttataattcaaaaatctggttcttgttttttaaaatatgtattttcataaagttattaagtggaaaaggctggtgcaaaaatcaagattgcaaagtattttagctttttgacattaaaaatgttattttattagtaaataattttcctttgcagtcattactattattttgtgtatccttgatagcttccattggtttcttctctaatttgcgtggtatttcttcttaaattttacgtggacatagttgtattcaaatatagatatactgttgttttaagtggtatatgtaaagtacaagtttatagatttcttttatttaaaaatatacttgaaatgttctaacattaatgctttttatttgctttaaagggcttactaactcttagataaattgttctcgttgtaaaaatgaattgccatatactgtatttttgatgcaaaaaatacaatcagaatgccaaaatacgcattttttgttttgtatgaaaagtaattgatatatcttttctagtataatcattttgtttaagaatggttcttgaataattatctctagcacagaactttgttcttcacttagatttatgtttccaactgactagatatctgtgcggtatggctcagcaaaatctccattcttaatacaatgaaataaaacccttgaccttcctatccctcacgagcttgtccttctaggactctctgactttgtcgttggcacatttatttgcttttaatttatttttttatttttttatgtttttaacttgtttttgccagaaaactgggaggagttcttgaccttctctttctcacacctccaattatagtaatagcccagctgttctcttgtgcctgcttcttctcttcgtccttttcaatcyaggctctgtgtaacagtccaaatagagaaaatgtacatttgtcatgtcacttgtttgtgtaagactcctcagtgacatctgttatacttaggataaaaatccaaggaccttactgttcaggaagacactctgaactcagtcctctgctgaatggacagccccatctctccctccagcgcatccctgctcacatacgatgctaaatccatattgaatttgctttagctccctaggggactgaacccttttcataactgtggtcttcctaaatgcctggaatggttttcccacctccttgactggctaactttattcttgaaactaaaggttaaatttaccttcaggaaaaggcttccattagagcttaattcaaatcaggtcagactctcgtttctgtagctgcacttctcatctgcaactgcatgttaattgccgcaccacatgttgagtatctatctccgccatgagatcgagggtcagtgaggacaagagacctgggctcttgattggctgttacagccctggtatgtaagatcatcatatgcataggtaaaataaaaatttagtgagtgaatgtgtaaattggctttttaaacagctacatcgattagtgtcctttgaatatttgtttttctggacagtcatttctgtccattgactgctagagattggatctgaccacaaccacacggtacacatattcacacgcagctggaattaattattttctttggacttgtacttgatgccttggattttttttcttccagattcaaaacaagtaaaagaataaccccttgacatcatattggatttccagtctagctaggtaaggtcactgccacagtgaaaagcagtgaggttccagaggcaaggcggtgggagcaatacaacccagagacttcagagaatttagaagcagtaattgtctgtagaaaatttcaagctagtgataaaaccaactaaaagttgatccgctttttattattaccattgcctggcaattttaaacagtgccaatgatttaaatactcctctaggggaagggagagaacttttggtttcagttctaaacttactataatcagagttgagtttttatactacaagtgtatcctttaaattagaagaattactcattatgctttaataaaacctgtttcttacttgaaaattaatttagagaattcactattgcgtagttcctgtctcgacgggactcagctatgtgcttgtgttttaggagagtagttcataatagtttgaaattgggcacagttgaagtctccaaatagcactacggatttctacatttatatgatatatttgaaataaacaatgctagcacaatgactataatggctaaaaaaataggacttgagttgcttcagttcttctattctatgcaaccactcagtttttatatgtgtttttaaagcttatggtgaaacagaatgcataatgcaaggtactttctaaaatatttttgtttggaaagta

SEQ ID NO: 131 - DNA, 3001 bp, Homo Sapiens
  allele 1501: 99-25969-200 : polymorphic base C or A
  misc_binding 1502..1521: 99-25969-200.mis1,  complement
  misc_binding 1482..1500: 99-25969-200.mis2
  primer_bind 1680..1700: upstream amplification primer, complement
  primer_bind 1171..1191: downstream amplification primer
  misc_binding 1489..1513: 99-25969-200  probe
  misc_feature 454,710,842: n=a, g, c or t
ttgcccaggctggagtgtagtggcacaatcttggactcactgcaactactccacctcccgggttcaagcaactctcctgctcagcctcctgagtagctgggactacaggaatgtgccaccacactcagctaatttttgtatttttaatagagatgggatttcaccatgttggtcacgctgatcttgaattcctgaccttgtgatgcacctgcctcggcctcccaaagtgttaggattacaggcgtgagccactgcgcccaaccggaaaacctattttaagacaagtctcttttccaattctcttttgctagatgacactgattttttttttaagtttgaaaggagtgctatagatttattgtatctcaataattcaattatttacatctgtccagtgtttcatagttttcaaaacacattcatatggaataaaatactctttagtcttcctaanaaccccataaatcaggttagccaggcatcatgagtgattctgttttctatcacagagaagtaagatcgggtagttgtttaaactttgacattggataaacactaaactgtgtttgaatattggctctgaaatttactcataactaacacttggtcaaataaattgcgtactgaatcatccaaaaatatttcattagcatctaccacatgctggcattccgctgagcactgggctggattggagggtcagatgtggncctcaatgtcatggtcctgcatacacatgtatttggagataggctcacattttaaacaaaaacgcaccagcctaaaagtgtgtatgtgtatttttctcatatcatgctaccggaaacgtctagaatagtgcnaatatagaagggaagaaaaagtcttttttcataatcatattttcataaacatatttccataaacataattcagggatttatattttctctcattttaattgtattcttaaatattttgatttaatatttaactttttaaaaattaaaatagtattcttgtaaaatacttattttctatgcctagtattatatggcatctattgcctgtcaagacagtggcattaaaaatttttttaaactcattttgaaagaactctgtaccagagcagctgtcctaaaaataaaaaaacaacactcggagagcctttggttttggtgcccttctcttgctacggtgtttgcttttctgcactcctgacttcactctttgctgttggtaagcatggctccctcccctgcttccttatggcttctgaattgaactcttattttgctctgttctgtacccctcccttttctcagattttcattgacatgtgaagatcattctctccttccagagtttattttacatgaggacaaaaaaaatgcttttaacttgatattgactttatgggtctaccacatataatttgttatatgttgacaggatttctaggtgattcatggggcatctgtgattctccctctgtctggtttggagaatgtggtaggatttmtatgctacacagtttacttgactgtgtagcatataaatgctgtacttgacttgaatatgtcacagtgtacattattttaaagactgcattagaacaaaatcagctggtactccttagctaaatctcctggtggcagtttaaaattttacttgataatctgctttgaaaccagaaatgtgtaaaagaaggagtcactaacttcctagttactcttaagtatatatagagggacattggacaaagtttatattttctgcaaagcacttaaatatatatgtattagaaaggaatggttacagtttaatataagggttggaaaactttttatgaaaagggcaaatagtaaataatttagaattaattggttgtacatttctgttgcaactatcccacactgtcatcatagcacaaaagaagccacaggtcctacataaacgggcatgtctatgctccagccacattgtatttacaaataggcagtgggcagagcttggcccataggttctattcatagtttgtgaacacctggtttagtatattataaatacatcccaagagcatctcttatgttttttggaaccctctggatggggaaggcataaacaaatttcctcagtgggggtttcatgtaagtattcacactctcccagctgctatgagttgtctatttaaaacctagccatgagccttgtatgacctgtgattttacagtgattctgaaccatttttcctcctccagaaggaggtatgtacaggtgctccgcagtcacattagtgtcatgtctcagcggtgaggaagagacacacaggcaccaaagagtggcatgcaatcatactaaagcaatctcagcaaaatggtcatttgtctatttttgttttcttttgtctcgtcttcctttttatttatttatttatttatttatttatttttgagacagggccttgctctgtcacccaagctgtagtgcagtggtgtgatcacgtctcactgcagcctcaaccacctggactccagagatccatgccaacctcctgagtagctaggactacaggtgcatgccaccatacccagctaattttaaagttttttttagagacaaagtctcactatatggcctaggctggtctcaaactcctgggctcaagtgatcctctgttttgatctctcaaagtgttgggattacaggcactcagccagtccatttttaattatatatgggactacttgcttttatttatcttgtagcttgtttttcattgtatttatatgaatctaacagctacaaaactacttcaacttttattttcttttcaatacctttcatttaactaagatttaacacgaaagaaattgctcacttctatttgcttgggaccaacacatgagactcttaaacaaggggcagagccctaagttaaataatgggcatttagttttgatgtgcattggttcagggtcctaagtcacctaagttttgtagatagtttctttactccacc

SEQ ID NO: 132 - DNA, 3001 bp, Homo Sapiens
  allele 1501: 99-25972-317 : polymorphic base G or A
  misc_binding 1502..1521: 99-25972-317.mis1,  complement
  misc_binding 1482..1500: 99-25972-317.mis2
  primer_bind 1795..1815: upstream amplification primer, complement
  primer_bind 1368..1388: downstream amplification primer
  misc_binding 1489..1513: 99-25972-317  probe
  misc_feature 1274: n=a, g, c or t
ggataaagtgctatccaattttgagagctatctgcaattttgcttaatattcgctttgcataaagtcagaaatttttggagagaactataattgccccatatttaaaatattattgagaatgcaatagactgaattcaaaatgcactttgagattcagcctactcacttaaaaaataattttttccaagttcatttgcaaagttctgttgaattctttttttagttatacttagttatatttaaaaacttaataaaaaggcctgtgctataagaagttagtgttctttgccattattccttttagttttaaaggtactttgcagcacatgtgttagtacaacttacaaaatctggtaaaaataaaagggaattaaagatgttattgagatgctgtgagtttgcaaaacataatttaaaaagttaggaattaactactgatttcttataatagtgtatttttaactcttatctaacctggaatcatcttgcattgtttagcaaaattcatcttgcgtttttggagtcaaatgatggcaaaacagcacaagctggaaaactgatcatggattttgaaatagccaccgtcttttctgctcccagaattttatgaatatttttttcttatttttttccttaatcctaaggtattttatttctacaaaaacatttattgactcacatagtttgtcaggtatttaataaagaaaggttttacttcttgtgtgtttattcatttgcttaatcacaaaaaaactgtttcctccaactgtaattgatgtttctttagcttctttgactcttatcaagtggtttgtgttgttatcattgactttttgaattgtttagcacttttttgtcttcgtttcagtaacttcacatacagtatgtattcagaaaagagcctgaggtatgttaaaaggggtaatgtcagtgagccccgccacgtcacagtgacagcttcaggttcctgatatcttcttcgaggtgataaccattaatagctgcttgaagggctagatgtattttggttgtaacaaaagggagtgtaaagtgttgccagaatcatggtgatactctactggagaaaataagaaacactaaaaaaaataaataaaaaacttacctctaagtatgataaactccaaaggaagatgtagataaaaaaagacactaagatatttgtgtggcatgctataagcaagttttgaattgtattcttcaacatttgataaaacaaaaattcaaactcttaataaaaattaacccctctccnttttttttttttttttttttttcacttttctctgtgccaggcctggtgataaaattatcctgccaaagaccttggtctgaagccattatttgtgtagccacttcttcagaaatcagaaaatcatttaagcttgggttagacagctgtgtgaagtgttatcaagtaagtgacatctgcaaattagacagaaaagtatgcagctggcaaaataatctaaaatgcaacarttttctgaaattcttgggagctaaagaagggaccaggaaaaagagaaaaagaaacaaaaatgttttctaggctagattttaaagaagtcaagattatatatatatgtagcaaagaaaggccttacctatagcttaataattttaaaatgacatttctaatccaattatatgtaataatgggaataggacagacctgggctaaaaactgacaatttatgcctaagtgtgtgtgcacctgtgtgtcttttttagtgtctgtctaggtaaaatgaattctctagattaagtggaatgaaccaatgaactcataggtcacctcctcctcctctgccaactttttcattttggtttttacttagcttaattgcttttggtttgaaatttgcaatcctgctacttgaggttataaaacaatagttgacttaataagaacacaccaactaaaattatcaggagaaattaaggaatttcaggtcaataggaggatgcaagggaaacctctacattacaaacaatttatttatatgggctgcagttctctgttctagttatgtattgctgcataataagtcaccacaaaactcagtgtgaaagcaattatgattatcttgtccctgatgctgcagtacgatcaaggctccagtagatatctcagctcttctccgcatgcatctgctgggccagcccaaaagtaggggttatttgacaggtgggactagaattattgcagacatcacttgggttggcagtgaaggttggctgtcagctgctactttgcctgaggccatctgctagaacctttgcacatgttcttgcattgtggctagttggctttctagcagcatgtctaccgggttcccaagggagtatcccaaggagacaaaatggtcaaccatggctttcctgtagccataaccaaaaaacatacctgaaactaagaagaaaaagaagtttaattggacttacagttccacatggctggggaggccttagaatcacggcaggtgatgaaaggcacttcttacatggtggcgacaagagaaaaatgaggaggaagcaaaagtggaaaccactgataaacccatcagatctcatgagacttattcactctcatgagaatggcacagggaagaccggcctccgtgattcaattagctccccctgggtccctcccacaacacgtgggagttctgggagacacaattcaagatgggatttgggtgcagacatagccaaaccatatcaccggccttgaaggtcacataacatcctttctactctattcacaaagttctacctttcaaagggagggtctgtcatggaaaccacctcatgggaggaatgtcatttaacatgagcccagggaacaaaatatcttgcagaggccctctttgaaaaatacagtttgccacagtctgccacctggccacaacaatccattcccctcttccatgtaaaatgcattcaacctctccctcaaaatctaagtctcaggccttt

SEQ ID NO: 133 - DNA, 3001 bp, Homo Sapiens
  allele 1501: 99-25974-143 : polymorphic base T or C
  misc_binding 1502..1520: 99-25974-143.mis1, complement
  misc_binding 1481..1500: 99-25974-143.mis2,
  primer_bind 1623..1643: upstream amplification primer, complement
  primer_bind 1100..1120: downstream amplification primer
  misc_binding 1489..1513: 99-25974-143  probe
ggcttttggccgcatttatcacttgtaaaaagaattttactgaccaggaataaatacatttacaatgtgtctaagtaacgcctgtgtgattttcatttacatgacaatgaccctttccactgttttcttacaactttcccttcgactgcctgatgtttattggttcattatttgtaaaagagtaaaacctcatctgaaaaaaaaaaaaaaaaaagaaagtgtgttgtgtctttaattttaaaaaccgcccaagggccctatgggggatattaaatctgtctctttgctgtatatcttgatgtacattttagttgaaaccaggtgttttgtatattgaactttttaacactgcagggaggtaagtattcacagctggagttttatgcttcacacattttcatgtttgagaacaagaagcaacccctaggaaaacctcctccggcatgaagagaggctgaacaatgcgcttctgtagctagtggcaggccatggatatgatgaagtcacagatatcggaactgaatgcgagatagatgccagtgaaaccaagacaaaaactttcaaggaatccaagtgcacaggttctcagatcaatcacaagcgatgaggttgtcactgcacagaggggctgaaaagcagcatcaaagccactaaagagaggggagaagcttttgttgggccggcttttgtcttcataaccagcattggaagccagctcacatcaactgaaaggccgagttaatctatttctagtgaacattgttcgactgtgtgtagttagcccgtaatcattaaagaaaaataactaggttggcatgaccaaaaaagcattgattttcctgtggagcacatttgtatgagttgaattttttgcatatgttattgtgcgcatgagagagaagaggtgactgacctcacaaaacaaatgcacacagcagcgctgcttcttagcctccacaatgaacttggtgtttgtagagcaagacgtaagatggcctattaaaattaaaaacataacatttctaattcagccttttatggattcactttaacctttaaagactccttaaaaatacagcaacaaaaaaagcaccttttcacgatttggttagccttcctggagaaatttgtcatggcattgcactgagagttttgttctttgtggccagtaagaaaagattcagagagggggtaccgctagagaaggacagggtgagggagaccgatacactgcaatgtcttcatcccttcttagtatgtgactttgatgtcccacatctccagaaaagagcttcatgttagctctgatcattccagatcaatccagcccccatgcaaatgcagtgatcaggctatatttagtaaaatgttgttcattttaagtttttttattatttgagagcagagacttccagtaggcacagtttagaccctgttatctttgtctcacctccctctgctccaagacctcagagacccagactgttgttaggatgtcagygcttggaggcacgcagtggctgagcactgggttctgtgcagctctgacagtaggcaccatgagttttcaggccaagaaaaataacttaaaaccctaagaaaataaacaaccccaaggctaccaaggaaggagagattatagctgaaaaatgtcagtacttgacagcacaaaacagttgcccacatatgatgggggaaggaaaatctaaaaaacaaaaagttgatgggtgttttaacatgttttttggcagaatattttcgaagtggattgaaatattttccttcccagttagacctaggctcatggtgttttgctaatgattctctgagtaagtgttttcttcaattgctttgagtgacataagttgctcagatgggtcacaccctcatgttggaacatcgagtatgaagtttcatgtggacacacagagcagaaaatctgccttttttggaatttgggggtacagattcgctctgtgtttgtgacagaatgtcatcttctgtttgtgaggaagcaggttgaggagtcaataatggatgaaagtacaggagtcagagattgtggaagattctgaatgagaatgagtccaagaaggagggcttggctggcctgtaagtatcatgttctctgagctggagggtaacaagacacagtgatgcaaatcactgtctctcactacaggtggcttgggagtccttatctgatgcacatgtgcttttcagcctttgcacaataacatgtatcttttcatttaagcttgtggcaattatttgagactgattctattaccatctgcacagaggccaacttacttaaatgagaaataaaacccactaagtttttctggctagggtaggcttatctagtttaaagccataacttctattagttctacgtaaaccaaaattggtaattcggagatttacaagatcttggaaaattcaactttctgttccgattcttcacctcatattcaagttaacatacattaatctagacctggaaactgaaatctgatgtgcgtaggcctaaatgagaggacagaatcactccttcaacaatgtattaataaatatttcaactgtattaataaacacaataaacacactgataaaatgatgactatgtgataggccctgggctaggtgtcaaatacacagtaataaataagatgagttctatatctttaaggaccatgtattctaaattccatctggagtataatttttatttctcaattctattttgtctgtcatttttcctttatttttatggatttctgcattaaataacttaaaaattttaattataggccattgtatatttttagtccagttgaaaaagcaccttttactaactacagactgtggacagtgattatgtaggaattgaagaaataaaaataaaacaggagaagatctcaccttacagggagggatcttccagaccaggggacaacattattaaaccatatctttctctagacatgcaaatatcatt

SEQ ID NO: 134 - DNA, 3001 bp, Homo Sapiens
  allele 1501: 99-25977-311 : polymorphic base A or G
  misc_binding 1482..1500: 99-25977-311.mis1
  misc_binding 1502..1521: 99-25977-311.mis2,  complement
  primer_bind 1191..1211: upstream amplification primer
  primer_bind 1710..1730: downstream amplification primer, complement
  misc_binding 1489..1513: 99-25977-311  probe
catgccgcaggagccttcagagcaagaacaccaaagtcaggaagcacattcctcttctccagcagtatcttttcatcctcctccattggccaggcctagtatcctgggtcatgtctaaatgtggctctcttgtgtttttttttcttgcctgtgtcatggcttgtaatttttttgttgtagttgaaagctgggcgtgttgtataggacaataggagtggaggtaataggactatagtttgggggcttatgttaacctgtctagaatttgggttgtgttgaaggtttattggtactccaggggtcagagtcgtcatattcctctattggccttgcctttgtctcacctgttaactccagactttcctaagtggttctgctcaaagagacggtctgtatcttgtacatcttttagtgaaaattcacttttggtgtagtgatagatgtggaagatggaaaatgttctggaaattcatgactcatcctccatctcttagtgggcttgtgttcctgagctgcaaccttcactttcacacattttttttagcttccccactcctctcaggtgaaacaggaaggctggaggggcctacactcaggtaaatgacctttccacaggtagatcaggctctgataaagtcttttcctgtggggttaggcctttgttttagagaattttcttggtatatttcacagctgttactttcccttccttctgctaaagccaaaaggggatttttcttagctctaagaactaagtttctagttagaaactagtactctagtctctaagaacatggtccttactagctcctcactttcaaactaacccacacccagcttccagcaatttattaaaattaccatctaagtgttctaccagattatgtctctggtagcttctgtccaggtatatcaactccacctgtcagctgtgcctgtctctccagattttggggtggttaaccccaaaaccgcagttctgtaatgggtccaagagaacatgtttaagtttgttgagctttttcttattacatgtaatagagtgatcacttccaagttatttaacttttaaataaaaacctgttgagcaattaatatatacctacttctatattactttcggaacatatgtgctcttttaaacccatgtagttttcaaaatgttttaaattatgactgaccccaagtcccaattctctcaaaattgtctcaaataaacaagtattgagccatcgtgatgaattatgtttgttcacaggttattccatttaattttctcttcccacctcattaagatgtaaatagtaactcagcttcatagagaagactgaggctaagagaaaaggattgtccaggctgaaaggttagaaaaaggcagaagctgctcttctactcagatttctgacttcaattccacaaaggtcttaaaattaggaaagcaacacttaagcactttaaatagctatgaaaaatgcaaaatggaatctattcaagcccatgrttctgtgttaattgtgctctgatgattgttctctttctttgcagccccacggtaacggaggtggaagtcagttctgcttctctgttgttttgcaaggaatgttcctaggaatattctgttgcaccctgggaacattatcttcatccgtattttaagctttttatagacaagcaaaagaaccatttaaaatatatataccacagcttctgatacagtgttgaaatactacaggcatattaagcagtttctcccattcacaaaggaagagtcaagtgagatttgacaacaattttatgaaactgacaaaatgaatcacaatcaattaatatgtaatggttttatttataagaatttgatggtcaaagctgtgaaagcttatatacttctctctggaagcaggattaaaggagttccctcttggtgaactcaccaacacacaatcttgagctggagaagtcattacatcattacaaagtatgtaatttttgactttttatttattaatccccttagatacacaatgcattttacaataatgagaagttgtttcctaaagtgacaatcatttttcttcataaacataatttgcttccttaactatttaggagtatttagttcctttagagtccatatctgtttttgtctttatgggtcattccacaattatccttcacttgccataagtgagtcaatctttcagtttcattggttctggaaacctgtcttagtattttgttatattatctttctattttttacttgttatggttaagaaatacaactttatcaagtaaaagtatataaaagtagatattaatttctccatttgttagactgattattcactatgggcaaatggacttaagtaggcctttcagattattctgtgttcatatgtgagtagcagagttttcactttgtatcctagagggtattataaacattaattaacttctataacaaccctgggaaatgtaggctgtattatgtctattttgtagataaagaacttgcaacttgtaatcaagctatgctgagctaggtactgaagagtttctcacaaacaagaagatattgtcacaggtttgtactgaccaaaaaagaaaaaaaaaatcaaccgtgtttggctgccatttttatttgtgattttaaaaattttaaaagtaaatattaatttagttattactatgggcaaagcattaagcccacccacattctttcttgtttctcacaaaagttattccctaaacacattctttttccttacattcacagtttctcaccacccaatttgatctgtaaccttgcttctatctgtttattatgaatttaagaacagctggtgtttgatttaccaatttcccaccatttatgctttttatgtcatctattttgactccaatttgcatgtgtctgcaagcattctgaatatgagaattctctgctcatctttaatccaatttatttttgtttcctgaagtaccttattcccatactgtt

SEQ ID NO: 135 - DNA, 3001 bp, Homo Sapiens
  allele 1501: 99-25978-166 : polymorphic base T or C
  misc_binding 1502..1520: 99-25978-166.mis1, complement
  misc_binding 1481..1500: 99-25978-166.mis2,
  primer_bind 1644..1663: upstream amplification primer, complement
  primer_bind 1155..1175: downstream amplification primer
  misc_binding 1489..1513: 99-25978-166  probe
aaaaggcagaagctgctcttctactcagatttctgacttcaattccacaaaggtcttaaaattaggaaagcaacacttaagcactttaaatagctatgaaaaatgcaaaatggaatctattcaagcccatgattctgtgttaattgtgctctgatgattgttctctttctttgcagccccacggtaacggaggtggaagtcagttctgcttctctgttgttttgcaaggaatgttcctaggaatattctgttgcaccctgggaacattatcttcatccgtattttaagctttttatagacaagcaaaagaaccatttaaaatatatataccacagcttctgatacagtgttgaaatactacaggcatattaagcagtttctcccattcacaaaggaagagtcaagtgagatttgacaacaattttatgaaactgacaaaatgaatcacaatcaattaatatgtaatggttttatttataagaatttgatggtcaaagctgtgaaagcttatatacttctctctggaagcaggattaaaggagttccctcttggtgaactcaccaacacacaatcttgagctggagaagtcattacatcattacaaagtatgtaatttttgactttttatttattaatccccttagatacacaatgcattttacaataatgagaagttgtttcctaaagtgacaatcatttttcttcataaacataatttgcttccttaactatttaggagtatttagttcctttagagtccatatctgtttttgtctttatgggtcattccacaattatccttcacttgccataagtgagtcaatctttcagtttcattggttctggaaacctgtcttagtattttgttatattatctttctattttttacttgttatggttaagaaatacaactttatcaagtaaaagtatataaaagtagatattaatttctccatttgttagactgattattcactatgggcaaatggacttaagtaggcctttcagattattctgtgttcatatgtgagtagcagagttttcactttgtatcctagagggtattataaacattaattaacttctataacaaccctgggaaatgtaggctgtattatgtctattttgtagataaagaacttgcaacttgtaatcaagctatgctgagctaggtactgaagagtttctcacaaacaagaagatattgtcacaggtttgtactgaccaaaaaagaaaaaaaaaatcaaccgtgtttggctgccatttttatttgtgattttaaaaattttaaaagtaaatattaatttagttattactatgggcaaagcattaagcccacccacattctttcttgtttctcacaaaagttattccctaaacacattctttttccttacattcacagtttctcaccacccaatttgatctgtaaccttgcttctatctgtttattatgaatttaagaacagctggtgtttgatttaccaatttcccaccayttatgctttttatgtcatctattttgactccaatttgcatgtgtctgcaagcattctgaatatgagaattctctgctcatctttaatccaatttatttttgtttcctgaagtaccttattcccatactgttgtgacctctttctaataccttctgtgtcaacttcctcgtgtgtgcttcctttctgtagttcccatttaaaaaccctttgatcctctccctttccaatgattaccgtattttcccaaatattttatagtcaaatcctttaacttccgtttttatactcactgtgctcattcccttagcacatatccttttctctaacgcttgcaaaatctttcaaatctagcatacttcagatatctgaatagccagacgggctacttctttccatatcttacacctttttaatgttttctgcaatactttaaacatttgtcctctctgcaacattactagacaggttcccttctttaagttctaatcttttgaagcttctgacttccctgggccttcttgacactgtattttcttgcgctctctgactgctccttctctgttatatttgcaactcctcttttttctctcacctctaaatgcctcatgaggaaaccaatccttccctctgctcttataaactgaacctgctctatctgtgaagcttaacactgcctaggagagtagtcatggagtagaatacatagctgtacgctggatgcagcagatcagaaacaatgtctaactaaagcattcaagaaaataaaaataacctttcttcatttctacttaaatgagctctatttgagttttgatttcttcatttctacttaaatcagctctatttgagttttgagatctcattcaaccaatgcatgtcagtgcaaggtttgaattctggtgccggtctgccatcttgaatcttccacctaagatggtatttgctgaaggattcattgtgtggtgggatctttaaacagaaatccgagctggacactgatgagctcatcttacctccggtttgcctgtaggtaacggatacttttgtgtcctatctaaggctatgtagctattcaccaggtttatagtcacttggatatgataccctcttagggtctgaggaggcatatttacatagatttcctaaaaactcatttccattctttagccttttaatccccttcacaccgtacccctctccccagctccctcactcaaacctctgtctggggtcagggaatgggaccatcaatttgagacactgaatttacatgttttcttcatctctgtctccccgtttactctgtctagcgcaaatgatcttctctccagcctttatgggaaactcaagtccccagctctcttcacagtgacatttctctcacatattgaagtccctccaataacagtttagcgtcctggagatcaaaagcaagatagtccttaatttctattattttttgtcatgttggaatctaagatagactactctagcccctag

SEQ ID NO: 136 - DNA, 3001 bp, Homo Sapiens
  allele 1501: 99-25979-93 : polymorphic base A or G
  misc_binding 1482..1500: 99-25979-93.mis1
  misc_binding 1502..1521: 99-25979-93.mis2,  complement
  primer_bind 1409..1427: upstream amplification primer
  primer_bind 1924..1944: downstream amplification primer, complement
  misc_binding 1489..1513: 99-25979-93  probe
tatggcttctttccgtaaacatgccttccacactaaacttaatcatttctgggtttttgtttcaacataagagaaatgaagtgtgacttttactttcactcaaatacttaaagagtatttgatattactaatatcaaattagtaatatttgatattaatgttattatgtctaatattcatgttattatgtctcagggaatagtgaagttccaggaaagtaagggagacaggggaatgcacagctcgtggagcagtcagaatacacacaacacttattaagtctgccatcttctaaggtcatggttcatggtgcccttaaacaattacaatagtaacatcaaagatcactgttcacgcatcactataacagatataataataatgaaaaagatttaaaatattgtgagaatgaccaaaatgtgacacagagacaaaatgtaaagacactaatagacttgctggccgcaggctttccacaaatcttcgatttgtaaaaaaacacagtatctccaaaggagaataaagcaaactacagtaaaaaggagtgtgcctataattgtctgtgaaggagaaatagtctcaaaagaaaatgtagcatgtgtttgttccgtaatttttacaaaattaaaataaaactcacaaaaggtcttaaatgcaatggctttctctaaacataaaaactactgcctgttacattcaagcaggttctacagttgactttcttcttttgataaaattatgtgttttctgaagtatttgtttaaagacaattgtataactaaagtgtacactttaataggatatttgttttttgttattgttatgtttttgtttgtttgtttatgtttgcagtgcagtgacacaatctcagctcactgcaacctctgcctcctgggttcaagtgattctcctgcctcagcctcccaagtagctgggattacaggtgcccgctaccacgcccatctaatgtttgtatttttaatagagacgggtttttcgcatgctggccaggctggtctcaaactcctgacctcacgtgatctgcctacctcagcctcccaaagtgctgggattacaggcgtgagccaccacacctggccactttaatagaatatttgattacctgggtatggcagacacttgttactttctggctgctgcaaacttatccacccttacctggtagcatctctttcttgtgggggaggtccccatgttgtgcagtctccacaggaagtcaatttcctgcatcagttgcccactgtggcttccactatggggccaagtgttttaactaattctggttggagagggaggacagtcacttgacctaaaccctgacattcagatgttcagtactaggagtttgcttcttaagctaatgaaacaaacgccaaacatcaagagacactacagtaatcggagacaatgcagtgacaggattgactacccgtggatcagcctgaagcttcaccttttttttcaaagtgcattttgagartatttgtgctatccattagtaaaaattaccaaagaggagcataatggaagcatagagaaatagtaaaaatagaaacatccagatattctatgaaccctaggaaatttacacaacagtattattattcaatatattgttgtcgtgtggcaccaacgccagagaagaattaattgctgagcaacggcccagacaggagttcccaagaagtaggttcaggtccatgagttgggaacttgctgagttgctgtggatctttgcttctttaaagtgttgtccatggattgcgggcatcatcagtattacctgggatcttcgtagaatcacagaatcttggtccctaacccagatctgcagaatcagttactgcggcttcacatgatacccactggatgtgcatgtacattcaagtttgaaatgatggtgtgaatcaggcagcagaaatgaaatatagtctgtattatctgaactgtggtccccaaggctagcctgtgcaagaaaaggtgtaactcagtctgaagagaacactgaaattaaaaattaaatctatggagtcgttttattcttggctacataggtgtgtttcacattctttaaaatctcaaatccacacgttttctatgtaagaattatgcatctagaaaggataacgggggaaacatagtatttttttcctacatgaggaagttgagacatttccgctacatttgatcaaacctttcttttagcacatcactattattcgcttcctactaacaagaacttcaagcagagaggcttttagtgaaaatatagaggatgacttcagggaaattgtggtgctttcagaggccagatgtccatcgatcaagaatgaccccaggaaattggtgaaagtttttatcttgtggcaaagacaaaaaccatgattttaaggttttgaaaatgcatatgttctttttttgtgtgagtgcttcaatctgtggggaaaaagtaatttgagaagagttggttaagacttgagctgaataaaatgtgatgatctcctgcgtttacactaaattttaaaaatccattagctaagaacttataatacaaaaagtgaacttttaagagataatatgctagaaagttaagatctgcctacataaaggtaaagaaaaccccctttttttctgtttttgttttttaagagtcttgctctgttgcccaggctggagtgtagtggcacaatcttggactcactgcaactactccacctcccgggttcaagcaactctcctgctcagcctcctgagtagctgggactacaggaatgtgccaccacactcagctaatttttgtatttttaatagagatgggatttcaccatgttggtcacgctgatcttgaattcctgaccttgtgatgcacctgcctcggcctcccaaagtgttaggattacaggcgtgagccactgcgcccaaccggaaaacctattttaagacaagtctcttttccaattctcttttgctagatgacact

SEQ ID NO: 137 - DNA, 3001 bp, Homo Sapiens
  allele 1501: 99-25980-173 : polymorphic base A or T
  misc_binding 1482..1500: 99-25980-173.mis1
  misc_binding 1502..1521: 99-25980-173.mis2,  complement
  primer_bind 1332..1352: upstream amplification primer
  primer_bind 1817..1837: downstream amplification primer, complement
  misc_binding 1489..1513: 99-25980-173  probe
  misc_feature 1245,1633: n=a, g, c or t
tgtgcatgtacattcaagtttgaaatgatggtgtgaatcaggcagcagaaatgaaatatagtctgtattatctgaactgtggtccccaaggctagcctgtgcaagaaaaggtgtaactcagtctgaagagaacactgaaattaaaaattaaatctatggagtcgttttattcttggctacataggtgtgtttcacattctttaaaatctcaaatccacacgttttctatgtaagaattatgcatctagaaaggataacgggggaaacatagtatttttttcctacatgaggaagttgagacatttccgctacatttgatcaaacctttcttttagcacatcactattattcgcttcctactaacaagaacttcaagcagagaggcttttagtgaaaatatagaggatgacttcagggaaattgtggtgctttcagaggccagatgtccatcgatcaagaatgaccccaggaaattggtgaaagtttttatcttgtggcaaagacaaaaaccatgattttaaggttttgaaaatgcatatgttctttttttgtgtgagtgcttcaatctgtggggaaaaagtaatttgagaagagttggttaagacttgagctgaataaaatgtgatgatctcctgcgtttacactaaattttaaaaatccattagctaagaacttataatacaaaaagtgaacttttaagagataatatgctagaaagttaagatctgcctacataaaggtaaagaaaaccccctttttttctgtttttgttttttaagagtcttgctctgttgcccaggctggagtgtagtggcacaatcttggactcactgcaactactccacctcccgggttcaagcaactctcctgctcagcctcctgagtagctgggactacaggaatgtgccaccacactcagctaatttttgtatttttaatagagatgggatttcaccatgttggtcacgctgatcttgaattcctgaccttgtgatgcacctgcctcggcctcccaaagtgttaggattacaggcgtgagccactgcgcccaaccggaaaacctattttaagacaagtctcttttccaattctcttttgctagatgacactgattttttttttaagtttgaaaggagtgctatagatttattgtatctcaataattcaattatttacatctgtccagtgtttcatagttttcaaaacacattcatatggaataaaatactctttagtcttcctaanaaccccataaatcaggttagccaggcatcatgagtgattctgttttctatcacagagaagtaagatcgggtagttgtttaaactttgacattggataaacactaaactgtgtttgaatattggctctgaaatttactcataactaacacttggtcaaataaattgcgtactgaatcatccaaaaatatttcattagcatctaccacatgctggcattccgctgagcactgggctggattggagggtcagatgtggwcctcaatgtcatggtcctgcatacacatgtatttggagataggctcacattttaaacaaaaacgcaccagcctaaaagtgtgtatgtgtatttttctcatatcatgctaccggaaacgtctagaatagtgcnaatatagaagggaagaaaaagtcttttttcataatcatattttcataaacatatttccataaacataattcagggatttatattttctctcattttaattgtattcttaaatattttgatttaatatttaactttttaaaaattaaaatagtattcttgtaaaatacttattttctatgcctagtattatatggcatctattgcctgtcaagacagtggcattaaaaatttttttaaactcattttgaaagaactctgtaccagagcagctgtcctaaaaataaaaaaacaacactcggagagcctttggttttggtgcccttctcttgctacggtgtttgcttttctgcactcctgacttcactctttgctgttggtaagcatggctccctcccctgcttccttatggcttctgaattgaactcttattttgctctgttctgtacccctcccttttctcagattttcattgacatgtgaagatcattctctccttccagagtttattttacatgaggacaaaaaaaatgcttttaacttgatattgactttatgggtctaccacatataatttgttatatgttgacaggatttctaggtgattcatggggcatctgtgattctccctctgtctggtttggagaatgtggtaggatttatatgctacacagtttacttgactgtgtagcatataaatgctgtacttgacttgaatatgtcacagtgtacattattttaaagactgcattagaacaaaatcagctggtactccttagctaaatctcctggtggcagtttaaaattttacttgataatctgctttgaaaccagaaatgtgtaaaagaaggagtcactaacttcctagttactcttaagtatatatagagggacattggacaaagtttatattttctgcaaagcacttaaatatatatgtattagaaaggaatggttacagtttaatataagggttggaaaactttttatgaaaagggcaaatagtaaataatttagaattaattggttgtacatttctgttgcaactatcccacactgtcatcatagcacaaaagaagccacaggtcctacataaacgggcatgtctatgctccagccacattgtatttacaaataggcagtgggcagagcttggcccataggttctattcatagtttgtgaacacctggtttagtatattataaatacatcccaagagcatctcttatgttttttggaaccctctggatggggaaggcataaacaaatttcctcagtgggggtttcatgtaagtattcacactctcccagctgctatgagttgtctatttaaaacctagccatgagccttgtatgacctgtgattttac

SEQ ID NO: 138 - DNA, 3001 bp, Homo Sapiens
  allele 1501: 99-25984-312 : polymorphic base G or A
  misc_binding 1502..1521: 99-25984-312.mis1,  complement
  misc_binding 1482..1500: 99-25984-312.mis2
  primer_bind 1794..1812: upstream amplification primer, complement
  primer_bind 1293..1310: downstream amplification primer
  misc_binding 1489..1513: 99-25984-312  probe
agcctggtttgtgattgcagaaatgatagatgaagttgggttatccatggagagaagctaggaaggacaatgagactgcataaaccatggcaaactcaaattacatttaaaaaataatacagatttgataatagtgcccagaatggaaaattgagtatcttatctacatttaagatgagtgtccctctgccaggcaactcaaataaggtccattttagccgtttactattgaacagaattggagaataaatggaaaactattgactcaagtagaaaaccattgacttcaaaaatggtgagataattggtattttaaacatatatatttgactgtgcatggtcatatatgatttttcatcatgtcctctctttgtgttatgacttattgttttctaagcaagaataaaagatttccacttaaaaatgtgaaggatcagtacaccaattccttaaaacacaaaacatttagaggtaatttttctttaagaagcactttgcagttttaactgtatcttgattttattggttgcttaaaagtttatgtcttatttctcaagtgttcccaatcagatcatacacatctatgtaggtaaatttgtcaccactaacaacaacaaaaaaatgtatcaaacattcactctttacaaagtattgggttaaacctaggacgataagaaagataaatgagatacggtcttaacaatgagttctacctttcaaaaacatggactcattttgaccagcagaaccaagaaagagagaccgacttttaccttagtaagcataacttagtgacagcagtagaaatattgccagtgcaaggtactaaagagagaatgacaaactccaggaaatcctagtcctaactagaagatagagaaactaagtagtttattctagaatgagtgtacacgttcccccaaaattcatgtattgaaacctaatctccaatgtaataatgtttgcaggtgaggccattgggagatgatcactcatgaggatggagccctcattaatggaattagtgcccttataaaaagaggccccagagagcatccttacttcttcaccatgtaaagacccacagcagaaagaaaccgtctgtgaatcaggaagccagtcctcaccagacactgaatctgccagtgcgtaatcatgaactttcagcctgcagaactgtgaggaagaaatttgtgttgtttagaagccacgcagtctatggtattttattatagcagcctgaattaagacactattataaattctaatattcctgtcacaggactataatatgtagtaccgatgttctcagctggggtgatactgggtgctcctaccatctggtaggttgaagacagggatcctgctaaacatcctacaatacacaagacagctcccacaacaacaacaaaaaattacctggtcccaaatgtcagtcatgcagattattctacttgtgatttgataagcagtctgtgatgtagtacttattaatcaatarccaagatgctagttgaattgtaaatatttaatctggtttgtgtgttcccaaaactaaattagctaaattggccctatggagttgtgggtattaataaagaaattgtattgaattatttgactgcttacctagatagcattcaacaattagccattaaaaagatggaaataaacaagaaaaaatactatggaaacagtttaattgacaacaacatgaattcatttcttcaaaagttatgctgtggtggtagaaacacgagctttagattccaaaggccgagaaaggcaactcggaacattgtgaacttgacagtttggtcttgtgtctgtgagtcccagttaccctcttctgtaaattgcaagattttcaggccatcttgtacagctgctgtgattattggaattgagctaagcaaggcagggcgtatgttagggtctgaagaagacagctattattagagctgctaccactaatgttagaccttttattaagataaccattaatattcacggtgtgtattcccttggtatggcttgtacagaattcaatatgaatagcagaggaagaaagaatctgcgattagacttccttgcatcttgtctccatattttttttagcttttagaatttaggaatttttctgagtctcacggaaaattgccagttcctcatctatagaactaactttaatatatttttcttcatgagctgcatcaatgttcagaagtgtgttggtcttttctgtacagaagtatgaagagctgctcctattttgcacgcttaccctagcaaacattgctggaagaaataaaacctacattaggaagggtagggcaatgttagggaggaatattggagaattatggcagagtcacctctgttcctagcccactacatcctgtgaaaaaagtgatgtctaatgaaagtcaatccattctactttaatacagatggttaattatcattgactcatattgatattttattataatgacctcattattaaaagatggatccaattaagaatatatttacataacaataatataatttgactaggaagtttctcactaacactcaagtgtctaatttcattaagctaataaatattgccagagggctatgcatgtgatagtcgtgtctgaacttaccaatggctaaattccaatttccctgaaatggcccctggcattttaagtgttctccatgtcaatgaagtgcatgatttttaaatttattttatttttaattattatgggtacataatagttgtatatatttatggagcacatgtaatgttttcatacaggaaaacaatctgtaataattggggtatcagttcaaacaagggaaatattgtttatttctattcccaagttttatttggatcctctgttaaaatcaattccctaattatatcttctgtactagattttagttttctaccctaaaggatacttatgttgaaaatctttattaaatatattttaaaagcaaagtt

SEQ ID NO: 139 - DNA, 3001 bp, Homo Sapiens
  allele 1501: 99-25985-194 : polymorphic base C or T
  misc_binding 1481..1500: 99-25985-194.mis1,
  misc_binding 1502..1520: 99-25985-194.mis2, complement
  primer_bind 1308..1328: upstream amplification primer
  primer_bind 1756..1776: downstream amplification primer, complement
  misc_binding 1489..1513: 99-25985-194  probe
ccctggttttatcttattttatttatttatttatttatttatttatttatttatttatttattgtgcttcctccctgccccataatgtttttgtatttccagataaaatcaaataaaattaagcctttatcagggacatactcaagccacaatttttagctggagacatttcaaggaaatcactttttaagagattgtctgaatgacagagaaggcaaagaggcagctcaaattacctaaggccatgaggcattcaaattctatacttgggcaaacatcagctccctccctgatgtgtctgggagcaaggcacaatagcaggatgacggagcagtcccttgtctcctgctctgtgttcattagaggggactccagcccctccactggcatgattcagtacaggcgtccatgaattgttgcaattgcacaatggggcaagctactggcagtatttgccacatcagcattcctggttcagaaaacacaggctcttccacagactaatgaattgaggtgagactggggtctaagttctgcaattgaccacgatggatgattgtcattagcacttgaccaaagccagtttgctcagaggattagaggaggccaatcccgggaggccagcctgtggggaatcagcttaggtagttaacctttacctctcattctgcaaacttgggctcacatcgtgagagatgtatgtatctcccatttccctctgtcctgctttgtttctctctgcttcctcacttcctgatcatcagaaactacttagaacctccaaactcaccaggctgaccacccaggcttcagaattgaggactcttacttgcgcagttattgcaatggggtgtttgggagtgaaagtggggattgtaacttgcctcaaaactgatgtatacatcatgacatcatggtggtgattgattatttcttttttttttttcctggagaaaagcataagttcctttggtgcctaaatctattataaaatttggcatttgcaaatattggatgagcttccgtaatcaaagaaagtttcacttatctctcttttattgaacatctcgagcccatactgagacagaatttcaattaatagtttagtaatgaaagaattgtaaattaacctttaacttgataaaaaataactagggcacaagtcaatatacattattaatagtcatcacaattttgttttgttccaaacctttaagtcacaagactttatatttttggaataatttatgcagttaaatattctaatgcaatcaaatttaagtatttctctttcattcatagccctgctttgcttacaatcaaatgagatacaaggtatttaaacaactaactataatgtttggacatctgtgcttttaaaaatagatagactagttcaaaaaaacacaaataacaaaattcataataagtaaacactttgtcactttgttaagtgttcagtatctataacctacttaggtattatttcagcataatatayattattacattaacgacaaaaaaataaataccttagatctgtacaaaagtatagactgaactagataagacaagagaacatttttatagatttgaactcagagagctctgcacatcactttaagacatggctgaactgtccaagaagcatctgtgattattggggtgtcctccctgtgaaacttaaaacatattaatctctgacaatcacttgcaatcaggtaagattttcatcctgagctaatgtatgctgtgctgaaaactttactccccatttctcacatacggagatgattctaatatgttcccaaatgctaaacttattaagatagtctgaaaataaaatttagatttgacattttatttatagttataatatcatgtaacttctagatatatactgtgtagtataatatgttagcaataatatatgcaacattagacacatatgtatatgtgtatacagacacttgagggccacatattgttaaccaccctataattggataatacagttccataagcaagtgagttctacctacatttccaatcttttttttttctttttttcttttgaggcagagtctccctctgtctcccagactggagtgcagtggcatgatcacagctcacggtaaccttgaactccagggctcactgcaatctagtagctaggactacagcacacccaggccaccatatctggctactttggtttatttcttatagagacatggtctcactgtgttgcctggctggtctcaaacttctggtctcaagcagtcctcctgcctcagcctcctgaagctctgggattacaggcatgagccactgcccctagccctccaatttttttccttattttcaatctgtgccataacttctaagcatatgtgagttttccatacttacttaatatctgaaaaccaaattttttgattcactgggaatgccggaccccttagtatcattgaagttcttggaatttaagatttttatttttgaataaggcacatatcacctctggtgaaatcattataactgactgtcaataatgttcaagaagacagaattttaatacataccaaatggcaccccttggggagggggtgggtgtggaaaaaaagctaaccaagaacttagatgtacatatattcacaatgatgattacccagcaggaatatcttagaacaaggctgcttatttatagtgaatgtaatgagctttccgtactgagctcaactctttttagaaccacaaacaaagaaagtgtgtattagaagagctcttcaacttacaccatcaattggactctctgccaaactacaggagcaatctgagaccttgactagggtaagtggttcttagcagagttcatgacaaaatagcgaaagccaggggtgttctaccaacagcacgtgctgtatactgagttcctttcatacttgcaagaggccagcatttatttattttgcattgtacgcaaacatcttcagtgata

SEQ ID NO: 140 - DNA, 3001 bp, Homo Sapiens
  allele 1501: 99-25989-398 : polymorphic base T or C
  misc_binding 1502..1520: 99-25989-398.mis1, complement
  misc_binding 1481..1500: 99-25989-398.mis2,
  primer_bind 1880..1898: upstream amplification primer, complement
  primer_bind 1346..1366: downstream amplification primer
  misc_binding 1489..1513: 99-25989-398  probe
  misc_feature 1322: n=a, g, c or t
aaaaaagtcagccttggttaaccctttacattttatatcgatttcatgcaatagcctttcactccaaagaatttcatcttttatgatagtgtttctgcaagattatttagtatgttatataaaatgtctctgaatagttctttcaaaattacttagggtttatatcaaagtcaatcatttaactgttgttcaaaattgatgcctttctatgaaatagaagactggaaaggaattgtgattctcatggaaagagcaaggcaactgaacaaatctgctcattttaagtattattttaaagtctagctaatgaagatattcatggagaaagtatgttccctgccatgtactttctgtacagcttatcacagtctaagatgagacttaaaccacctccagagtatatgcattaactatctttttctagttggatattaaataatttaaagataatgatgttccataagctatgtttaaaaattagattttgatagctgaaaaataattggatttagaagaatccaaattttttcaataaaacttacctataaaagtaaattttgtatttttctatagtatcaaaatgatatgttacccatgaaagttctttcctttcattcaaaaagcatattttacaagtctacttggtatacattttttaggtactagatactgtaatacaagaaaaaaaaaaaaaaagtcattgcctgcccttgaggaacttccagtccacactgtctcctccagatagtttgcatttcatttataaaatatagtaattcgtgattcaggacgaatgagttggattttaccaattaaaagggattggagtgacagagaattgtcccaaatggaaaggccagcatatgtgaaagcctggaaggtcaagatttcttaaaataattttacgaagtattttctcaggtacctagagtatatagacttcccttgaaacctcacaccttcctcagtacaaagaactccaaacaccaaagataaactctttttaatctttttcacacaaaatgaagatgctaattcacaatgcctgctttgtatctacatggtcccagatataatgttggaccatggtctttcaaaagttttcaagaaacttggaaatatggattaacagcagaaaagagtgaaagcatagtactatgagttcagggtcatagcagaaaacaaatcaaagccttcggaagagattcttggaatctcttctaagattcctgttcatctaggggagaataggccaagttttttctaagctttctaaagtccctcattcatcaatgagctctaatcctcatggctttaaactnagatggaaagtaatatttcgttttcacagttgttttcaaatcccaatatgaactgaaataatctgaatgaggccagggccttacctctagaaatttcattttctaaaacatttgtatcttggaaagacagtatgcttgagtatggttagcaaagtccatagtgaatactcagtaaataygtaatgattattataattatcgctgttatttgagttagtagccactgatagtagttgtgatgcaaatagctctcaagaattactgtcttggaatacagaaaatcaaaactatcaccctgcaattaccctggaattagtttacatgtgggggtcggagagaaatgactaccaaaagtgatggtgagagattttaccttttattgttaagcatatgtacattagcactccatcaagccattttcatgatttcagggtaaactcagtggcattgcacttcttcgttttccaaaaatgacttgtgctttttaaatgtctgcattatctaagaatactaattaggtttgttttatacttactgcacctatagtgtaacatggggatttgaagataagatgggagagtgaatcctagttgtgagcagaatttctaatacaacatgatccatgtgctgccaaagttcagagaccacaccttgtctttgtttcacaggtatccacctagcattgttgttctcagcatgatatttgtctcctaaaataatcatacatttcttaaatacaaaacactgcactacctgaaaaaaaaggactagcattgattaacatagcaacactacgctccttgttgtggttattctgtattgtaactctttaaatggaattgggactgatgtcatttatgaaagttagttaacggtaaaaaaagttgtcatggaattgacccatcttcaaggactacctgggacattttagaatactgaaaaactaggttttaggtttacattttccaaaaattctagagataaacatattcagatctgtgctagaagttttaaatatgacacaacacacaagcatgaagccatgcttactttttgatctgattcacacatctttagagattacacttaacttataacatttccctttttctatatgtgcatcagacgtggtgctgactgtgacatttaaactgttatgacctagaatataaagttaaaattgctattttttttcaaaatggctggcagaaatcagtttctaaaatcctccttatactgtccccgtcttcagttagtgacaataagcaacgggcatgaaatttttaaaaggtttaacgatggagacagaagatgtccccttcaaattcctatcagcaaaagcaacagcagactcctgctaaggaacgttctcagatctcactgtgaccctgctgtgtgtcatgtcctgcgagagattgcacaaaacaacagtgtaatgaagtgtgcagacacttgctctcctctcttctcccatcatactagacccaggataagatggacaaaatgaaaaaagaaatatttaagagattaacaaacttgtgagcactttgaaagggtttgtctgaggaactatccacaatttgatcccatgcagggacaaactttccatcttacccatctgccttccccagcctccaaacaccaaatccagcccactctctttaagataaatcaatttg

SEQ ID NO: 141 - DNA, 3001 bp, Homo Sapiens
  allele 1501: 99-26147-396 : polymorphic base G or A
  misc_binding 1502..1521: 99-26147-396.mis1,  complement
  misc_binding 1482..1500: 99-26147-396.mis2
  primer_bind 1879..1896: upstream amplification primer, complement
  primer_bind 1433..1453: downstream amplification primer
  misc_binding 1489..1513: 99-26147-396  probe
ccactgcactccaacctgggtgacagagtaagactccatctaaaaaaaaattaaaaataaaaataaaattatatatatatatatttctctacctcatgtttactcctctgcaaactcatattagtggtaccaccttgaataagcctttaaatactatacttgaaacactatatattaaaagcctgcagcaaaacctctgtccctgtctcactccccttcagttagagaaagaactgcatttgaacatctgatgtgataaaatagaattccatctaattctattccatctaattctattctatctaaatagaatagaattctatttagaattctaatattagcccagtaattgagttgttaagattggtttctagaagtactgctaattgctagactgaggcaagttattctcctttatgctgggaccaatttgtcctgtttttaagattgggatattagtatcaaatttaaacattatatctctcttacctaatactgatcttatgaaaatagagaatgcaaagctaaatttaagattcttagaaaacaaagttgttgatgataaaataacatatttaatatggtttggctgtgtccccacccaaatctcaacttgaattgtatctcccagaattcccacgtgttatgggagggacccagggggaggtaattaaatcatgggggccggtcttttccatgctattcttgagatagtggataagtctcatgagatctgctgggtttatcaggggttccaggttttgcttcctcctcattttcttttgacactgccatgtaagaagtgccttttgcctcccaccatgactctgaggcctcccaaccatgtggaactgtaagtctaattaaacctctttttcatcccagtctcaggtatgtctttaccagcagcatggaaacagactaatacaatattttgtattaatatcttggttaacttaatagaaaagtctatgcttaatacaatgctttgagcttgaaggatttcaagagggatgcatgactattgacctaaaatgaagttataggagttcttggaattatctaaattttttttcttgatctattaaacacttcacttttatgaagaagatgttttaaaaaagaaagcaaacataaaggctaaccaaaaacacaccagtccttcaaggacaggccaaggagcttagaattattttatgactaatgctaactctgttattatttaacaacaaaatcttgcttaaaattgcaaaaccagagttgttgcattcatgaaatgacaacattaatgctttctggatatagcatacggtgattctttattttacccaactaaaaatttgaagccaataaaatgtttctctcagactagttgcttaactaaattattcaactttgggtcaatctaaatttcaaagatacgttaaagttcagagaatgctactattgctactaataaaattagttatttcaatttttgttttaaaaattatatctgcarcaattaatttggaggtcttgggaaattcaaaaaaagaatgaactccttgatttattggttgatttctcaatcacatgttgtaatgcctactctgagaacagtattgctctaggcattgtgggaaatttcgagattactatacaataagtaataataaatacatggaagatagagagatatagagacatgtagtcaataggcgacttcatatccaatgtaaataaaatatataaaaaattaaacacattagtttttgtttacctgtactcaaggtagttccaaatatccaatgaccttcatcttgcaattgaaggtaaaatccagacttagatgctttgttagatttgatctcattccctcatattttcttctccagggtagatgttaggggtagtttgcctcacgccaggtcttcctcccatctggacctccttggacaagttacatacctttattatgacttaatttctgtatctataaaaggaatatggaaataaccatatttttcccactatactgataatcgaattaaatattttacaatatttaagtcctaaaaacagtggttggcacttagtaagtaccttgcagggcctaggcatgttcccgctggcttcctctgcagtggagctcccctaaggtcttagccagcatttcttgcagacaatgcctgatgtctgaggtcccccctcaatatccaaaccctgggtttgcactctgagtttttcaaaccctgactgagccaggtcatgtcatcctctcccttggctggtgtgcctttgaggatgccttcaggcccttctcctgaacaaggcactgtgacattgctactgacgattctaactccatgcccaattagggcatctctctctgactgaaatttccaggaaatcagggatcaggtcctttatctcctgggatttccccaaaacaactgtgaaaattccatctttttattctatctctcccaaggtttttgatcctactagaggccaaggtacaactacctttgatatggtttggctgtgtccccacccaaatctcatcttgaattgtagttcccgtaatccccaggtgtaatgggagggccccagtgggaagtaattgaatcatgggaatggggactattacccccatgctgttcttctcatgatagtgagttctcacgagatctgatggttttataagggacttttccttctttgcttggcaattctccttgctgccaccatgtgaagaaggacgtttttgcttccccttctgccatgattgtaagtttcctgaggcctccccagccatgctgaactatgagtcaattaaacctctttcctttataaattacccagtcccaggtatgtctttattagtagcatgagaatggactaatacacccttttgaaaaaattttgcatcagtcattaaccttctttgtattttccataattctggctctttccctcattaaacaatgactgtatcattcttagtgggactgagatg

SEQ ID NO: 142 - DNA, 3001 bp, Homo Sapiens
  allele 1501: 99-26150-276 : polymorphic base T or C
  misc_binding 1502..1520: 99-26150-276.mis1, complement
  misc_binding 1481..1500: 99-26150-276.mis2,
  primer_bind 1758..1776: upstream amplification primer, complement
  primer_bind 1323..1340: downstream amplification primer
  misc_binding 1489..1513: 99-26150-276  probe
  misc_feature 2165: n=a, g, c or t
catcattgcattgaaatcaaacctaataaggcctattgtgttcacgcatacaatgctgtgcggttaagtcagttaaaactcactccagcatcgagccctctccagtcaccagaagagcatatctagcatttaattagctttaattagcagcataaaacctccaaataccaggtagctgaagtggcttccagaagtaactctttataaatcttgaatgagtaatcacttaacttttgtgatccactatcatagtggctgcagtcacctgaccataagctgtgttttccatctaagagagcttctggaaatgaaatataattattgaaataataaggtactacatcttgtgctgttttgttcatgatttcaaaatcattaaattatcccaagagaaaatcaatatgatgagaatgcaagtatgatatatagcatttgaggttttcttcagcgaggcccctgttgtaacttgttaattttaattcattaaagttctatatagtatatgtttttactcttattcatcagtatataatgaggctgcacattggaaaaactaagtcttttaacctttgattaagataatttagccttaggcctggtgtagtggctcacacctgtaagcctagcactttcggaggccaaggtgggtgatcacttgaggttaggagttcgagaccagcctggccgacatggtgaaacctcatctctactaaaaatacaaaacaaaacaacaaaaaaagaaaaaatggagtttagtcttaaatttttttttatgttaaatatttttcagacagactattggaaaggaggcttgatgtctgcaaagttagtgacaagtgaaaaggtggcaattagcaaggctgggagtaaaaatgggcaagacctaaatgatgttctgtgatgcctccctgtctcgtttcaccttgtaggctttgttcttatttgtgggctgctgcttaaaatgtacctggagaagggtgttaatgcatggggaacattatccaccccacctaggacatgatttaatagcaaaggacacagaaagcatttattcacactaggaccaaaaagactcaagttgaaaggtaaacaatgctaaggccttatgccagctctgtatgatcatttctgattcattgcagtcaaatccttgaaatgtttctttaggtcaatttaaaaatcaggcataccaatcatgaaacatgtttgaattgtctctgtatataatattcaaaacacattataattggagaaaatacactcatccgacttggctgtcattcagttcaataggtattatctactatgtgctatatgcactctgtgccaccaaaagtaccatatttctttgcatctcagatgccatgtatcatagcatatgtttttaacagagaaaaacaatgtatcaaactgacatgtcatcaattagaagatgcgttcaactttagaaacctcaaaatatgaaaagttagtatgctgttaaataaactgtccaaaataygctcatttatctccatctccgtggaaatgaccacagtacaaaacaccagattgtcacatgaaccaaatgtctcaataggccttcctcaaactgagtcttatctcctctctgactctctccgctcgcaattcattctcctccaacaagctggtgtcttttcaaattgcaaagttgattgtggtacgaatattgcagtaactgttcttggatcccttgataaaatattaaaaaggcagaattttagagatcagattatctcatgcaactaatctttctagaacttcttgaagtacaagctttcatatcatgaaataaactctgcaaaatatatatttttgtcatgtttaaaaaacatttaagccatgagttatttgggggggaaaaaagggggggctgggcgcggtggctcatgcctgtaatcccagcactttgagaggctgaggcgggccgatcacgaggtcaggagattgagaccatcctggctaacacggtgaaaccctgtctctactaaaaatacgaaaaaattagcagggtgcggtggcgggcgcctgtagtcccagctactcgggaggctgaggcgggagaatggcgtgaaccctggaggcagagcttgcagtgagccactgtactccaacctgggcgacagagtgagactccgtctcanaaaaaaaaaaaaaaaaaaaaaagatttattggcagattgtatttctaaacatggccagagcaatactttctatcttaaaggcctttttgcctggtcatcttgaagctttctatcaagatgtggagtctacaataatttgtgacaaaagaaaagttatgtcacttctcaggttggctttaggagatgagaagcttctgctttccatgtatgtgggctgccatttctttggaaggcactttcaatgctgcgagaagtccacaaggccatgtggagtagaagcacagccaccgttgaaagtcccaggtgaactcccagccggcagccagcagccccttccagacatggacccagatcattttaaaaatttcccattctgaccaaccaccagctaaatgcagctaagtaaacgatcccagtgaaccccacttggagaagcagaactgtgccgcctaacctgagttcctagtctcagagtcatgaacaaattgcttttatttaagccagtaaatttgggggtactttgttacgcaggaacagatagtcaaaaactattttctatttggaaatgtttcatattttgtgaagacaaattaaaagaagaggtcacatttatcaccacaaatatctagagaaaaaatcattttaaaaatatgataaagagctgctagagaaaaatggtacatttaaaaaaagctaagcaagcattatcccagcacattttacaataatctttcaaaaaataattctttgtatatttgtttttatgactgaaagtgtatgtttaaaaaagattttcccagtgattcttattaactatcaatgatttttggtggtat

SEQ ID NO: 143 - DNA, 3001 bp, Homo Sapiens
  allele 1501: 99-26153-44 : polymorphic base A or C
  misc_binding 1482..1500: 99-26153-44.mis1
  misc_binding 1502..1521: 99-26153-44.mis2,  complement
  primer_bind 1458..1476: upstream amplification primer
  primer_bind 1885..1905: downstream amplification primer, complement
  misc_binding 1489..1513: 99-26153-44  probe
accccatatttcccttccacactgccctggcaaaggttctccatgagggccctgtccctgcaggaaacttctgactggacatccaggcattttcatacttcctctgtaatctaggcagaggttcccaaaccttaactcttcacttctgtgcactcgcaggctcaacaccatgtggaagctgccaaggcttggggcttccaccctctgaagccacaacctgagctgtaccttggccccttttagccatggctagagtggctgggatgcagggcaccaagtccctaggctgcacatggcaggggtccctaggcccagcccatgagaccatttcttcctcctaggcctctgggtctgtgatgggaggcactgctgcaaacatctctgacatgtcctggagacacttttcccattgtcttggggattgacattcagctcctcattacttatgcacattacttcagcgggcttgaatttctcctcagaaaatagattttccttttctatcacatcatcaggctgcaaattttctgaatttttatgctgttttccttttaaaaccaaatgcttttagcatcacctaaatcatatcttgaatgctgtgctgcttagaaatttcttccgccagatatcctaaataatctctctcaagttcaaagttccacaaatccctagggcaggggtgaaatgccgccagtttctttgctaaaacatagcaagagtcacctttactccagttcccaataagtttctcatctccatctgagaccacctcagcctggatttcattgtccatatcactatcagcattttggtcaaagccattcaacaagtctctaggaagttccaaactttctcacatctttctatcctcttcttagctctccaaactgtaccaacctctgcctgttacccattccaaagttacttccacattttggggtatctttacagcagcacccagctctccaggtaccaatttactgtattagaccattttcacattgctgataaagacatacctgaaactggggaatttatgaagaaaaagaggtttaatgaacttacatttctatgtggctggggaggcctcacaatcatggtagaaggtggaaggcatgtcttattttggcagctggcaagagagagaatgagagccaagaggaagggttttctccttataaagccacccaatctcttgagacttattcactaccatgagaacagtatgggggaaaccacccccatgattcaattaccttccgctgggtccctcccataacacatgggaattatggaagctacaattcaagatgagatttgggtggggacacagccaaaccatatcaacataaaatataattataatacaatgtagattatatataatataatagaaatgtatacataactatgtataacatatatctgatatatacctaagtatatgggtataactaatgcttaatgcacatctacataatctatataaatcaatcaatcmatctatgtctacctgttcagggtataaaatctttgcatactacgttaacatagtatacaagttccttgtgcaacagatagtgtacagcaattaactgctgtcaagttttatctttcctgtaaaactcccagcacctgcactgaacttcgctggtcaataagtgcattatatacacacccatatgcacatacatatataatatttttatatgtcaattgctcctctagattgagtccaatgctcagaattataacggtaatttctcaaaaacaaagaaacggaaggaaagaaggaagggggatggagagaagtcagaaacagagaatgagggaagaagaaaggaagtgctgaaaatgtatttggggtgaataaacacatgagatggtataaagaggcaggtaatgtttcacttctttaatagaaatggcaacacctttcagttgaaatcaacttacactttacaatcagtgattttgtgtcattaggtaaaattatttgttttctaaacctcagttttatatacacacacatacacaaatatatacaatatctatattgtatatacagcatatgtatctatacataaatacatctaaacaatgaacatatttatttacctaagtgattggcacataaaaatggtctaataagtgatattagcagttggtccattagaattgttggcgaagattcaaaggcagctagagattgaattgcagtgaaccttgaaagtttgataaggaatctggatgacatttggtggttaatacttattgaaagttttaaagtcagggaactatctgataaaagccacagctaacataaaatatgtttgagaatgttctgaccacagaatacaaaatgttataaatagaataatttcatttacacattaatcacttaaattttgttaggcattgacatttcctaataaaattaaaatctaggaaaagtcagtcatggtacaaatcaaaggggtagggattatgaaatacccagtaagagaggaaactgctatagcactgaatcagtgtatcaggaccaattaatttatttttgctttattttccctgatcataacttttgtgtttgtttgcattgtttaatttactgaatatgtatgttagattataaaactaaagatgtaagatactgtgaggtccattccctagggatagctgagtgagggtcaatagaatgaaacaggaaaccagggtagcttgcaaactggagagaaaagactgatggtgatcaaattatatcaatctcattgattcttccaaagagctctgagcagggatggaatacaaccgccccgttcagtcagaaggtgttttgcagggtgttttgccaatgtcctgggagctgccaccgaacgatggaggtgccaagaggttggacatgtgagtgatatcttaggcctcactcatgcttcaagcagacgtttttttctattagctgctttctctatttaggcttatgtaagattttattttaaag

SEQ ID NO: 144 - DNA, 3001 bp, Homo Sapiens
  allele 1501: 99-26154-107 : polymorphic base G or T
  misc_binding 1481..1500: 99-26154-107.mis1,
  misc_binding 1502..1520: 99-26154-107.mis2, complement
  primer_bind 1396..1415: upstream amplification primer
  primer_bind 1903..1920: downstream amplification primer, complement
  misc_binding 1489..1513: 99-26154-107  probe
gcactgaacttcgctggtcaataagtgcattatatacacacccatatgcacatacatatataatatttttatatgtcaattgctcctctagattgagtccaatgctcagaattataacggtaatttctcaaaaacaaagaaacggaaggaaagaaggaagggggatggagagaagtcagaaacagagaatgagggaagaagaaaggaagtgctgaaaatgtatttggggtgaataaacacatgagatggtataaagaggcaggtaatgtttcacttctttaatagaaatggcaacacctttcagttgaaatcaacttacactttacaatcagtgattttgtgtcattaggtaaaattatttgttttctaaacctcagttttatatacacacacatacacaaatatatacaatatctatattgtatatacagcatatgtatctatacataaatacatctaaacaatgaacatatttatttacctaagtgattggcacataaaaatggtctaataagtgatattagcagttggtccattagaattgttggcgaagattcaaaggcagctagagattgaattgcagtgaaccttgaaagtttgataaggaatctggatgacatttggtggttaatacttattgaaagttttaaagtcagggaactatctgataaaagccacagctaacataaaatatgtttgagaatgttctgaccacagaatacaaaatgttataaatagaataatttcatttacacattaatcacttaaattttgttaggcattgacatttcctaataaaattaaaatctaggaaaagtcagtcatggtacaaatcaaaggggtagggattatgaaatacccagtaagagaggaaactgctatagcactgaatcagtgtatcaggaccaattaatttatttttgctttattttccctgatcataacttttgtgtttgtttgcattgtttaatttactgaatatgtatgttagattataaaactaaagatgtaagatactgtgaggtccattccctagggatagctgagtgagggtcaatagaatgaaacaggaaaccagggtagcttgcaaactggagagaaaagactgatggtgatcaaattatatcaatctcattgattcttccaaagagctctgagcagggatggaatacaaccgccccgttcagtcagaaggtgttttgcagggtgttttgccaatgtcctgggagctgccaccgaacgatggaggtgccaagaggttggacatgtgagtgatatcttaggcctcactcatgcttcaagcagacgtttttttctattagctgctttctctatttaggcttatgtaagattttattttaaagcctctgctatttaaaaaattagaaacccactgacagtgaaactaaatttggaggtaggcatatatcaattctagtagcaactttagatccactttagaataccctgttcagaagattctaagtaccccttccagtgkctgggaccatccagggccagcagtgctggcaggaatctagcctgggtctgaaagggactcgcgtgggcacgggttcctgtactcttccctttggggcatgtgtggtccctcatcttatgagtgggttcaaatgggtgcccagaggagccctgggactcagtctttgggttccattcagacccgtggcctcatcggtccaggatataccactggcagtcacagtatttctttccgaggatctggtcactgtcacacttgttgacacaggacaaatttagagcatagggctacctgcaatccactgtgactttctggtgtggctgcatgctgattctcacctctgggttccaaccatggaaccatgtctggtttacatcagtcaaggctggcatgggtgacagcaaccttccttaccctgtgtgtccttgcccctggggtggtcacccagtctttctgctggctctgtactctatgtgaggcagatctgggtggctgcacctctctgtttcaagagcttttgagatgattagtccacaatgctaatgggcctttccaattctcctgtctaacctcaaccaatggggtgatatcatgtttgctgagtggtcatctgccaggctcaatgatggattgccatactctgcataaatgggattgttccagctccacacgcaaactccatgtttatccttcctgctggggatcaggtgtgtggccagcagaggcatcgtcaacatgggaagaggaacatcctctacatacagcaattatgggttacagatttccacagagcacctgattggaaaattgttctgtgttcacactctaaaagttgaaaaagttaaatgtaaacttaacataaccagacaaagaattagtgttcacattttgctatatactttggattggattgtgatcatgatcgaagagaagagtccttgaaactcagaggtcacaggcagcaggatggacaatgccaagtgatgagggatgatatacccagcattgaaacaatgatgtcaagaaaccacagggaaaaggccatctatattgttcaagtacaaacacaggcctaacaaggagggtaataggagggttgctaactttttttactggtaggagatacaaaattagcccagcactcaatatttgacagttaagaacacaaagagatagttcccgcatcagacaagaaagacaaggtagctggacaatggacagatatgtaatccactctgctctactcattgatataaatgtccagattgaatcattatatttcacaggagctccaacattttgtatttgttattgcagtaaattatacataacataaaatgcaccatcataaccatttttaaatgtacagtttgttggcactagggcattcacactgttgtgcagcttccaccaccttctatcaccagaaatgtcttgtcttcccagcctgaaactctggacccagtaaacactatttcctcactttcctctccactgagc

SEQ ID NO: 145 - DNA, 3001 bp, Homo Sapiens
  allele 1501: 99-26156-290 : polymorphic base A or C
  misc_binding 1482..1500: 99-26156-290.mis1
  misc_binding 1502..1521: 99-26156-290.mis2,  complement
  primer_bind 1212..1229: upstream amplification primer
  primer_bind 1702..1722: downstream amplification primer, complement
  misc_binding 1489..1513: 99-26156-290  probe
ggaaaattgttctgtgttcacactctaaaagttgaaaaagttaaatgtaaacttaacataaccagacaaagaattagtgttcacattttgctatatactttggattggattgtgatcatgatcgaagagaagagtccttgaaactcagaggtcacaggcagcaggatggacaatgccaagtgatgagggatgatatacccagcattgaaacaatgatgtcaagaaaccacagggaaaaggccatctatattgttcaagtacaaacacaggcctaacaaggagggtaataggagggttgctaactttttttactggtaggagatacaaaattagcccagcactcaatatttgacagttaagaacacaaagagatagttcccgcatcagacaagaaagacaaggtagctggacaatggacagatatgtaatccactctgctctactcattgatataaatgtccagattgaatcattatatttcacaggagctccaacattttgtatttgttattgcagtaaattatacataacataaaatgcaccatcataaccatttttaaatgtacagtttgttggcactagggcattcacactgttgtgcagcttccaccaccttctatcaccagaaatgtcttgtcttcccagcctgaaactctggacccagtaaacactatttcctcactttcctctccactgagcgcatgaccatctcccttctactttctgtctgtatgaattagctactccaggaaattcttataaatggaaccatacaatttttgtctttttgtgactgtatgagtgtattatactaatactttcaaggttcatccatgttgtagtatgttagaatttccttctttataaggctgaataacattccattgtgtgtatatattacattttgtttatctattcatccctcaatggccacctgggtggcgtccaaattttggctattgtgaatgctgctgctattaacataggtgttcaaaaacctattgtttttagttcttttgggtatgtgctcggaaatggaatggctgatgaatgaagtatttttctttttaatttctgaggaactgccacactgtttcctatagcagctgcgctattttgcattccttgtagcaatgtacgagggttccaatttcttcacattcttgccatacatgttatgttctgttgtattattttttaatagctatcgtgatgagtgtgaggtagtgtctcattttggttttgagttttcctaatgattactgacattgaaaatctttttataatgtctatatttataaaattatatttatatagacaaagacccccaaaaacatatttgtctagggccttgtagacccaaggggaagccctgatggattcgaatcctaattccaccacctattagctgtgtagtgttgaatatatctgtaaacctacttgagtatcagaatttttatattggctgcattttaactgtagatagctgttctggagcaamaatactgtaaaattagtcttttcttgaaaaacaggcagaacctagtattgacagatataactattttttgcacccctcttctatatcttatgctattgtccacgagcttattatattgtaacttgatattaattttaagaaagatttgaaattagccatattttagtatgtcagttttccataacaaggaaaaaaaaacacagaataaagatttaagccacaggaagggaagatatttcttttataaacacgtgattaaaaggaaaatcaattagaacttgaaagggttagcactggattactatcatttagcaaatgtattacaattgttttctccagtaaaaataaagattaaaaggaaagcataactatattagagagtaaaaaatagtattttattctttcaataagtgagattctaagaaatagaagatgagaagctaaatgtactgaatctgggggttccctgcctctgtgttgaccccttaatactttgtttaggttgtaaaaggttgttgcttttatgatatagacttttttggcccattatgtaagtaacctaggatgagtaatgaaatacagaatacagagtaatgttagaggaaaaaaataaaaaaaattattttcagtatgttatatattctaatctatatcttctgtttttgcttttatttttaaatgcataagggacataagacaatgctatgcagattaatggagatttttctctgcaaagccccttcttttcagtacattatttgcgaatttgaaatgctttggcctctgtgcgcgcctctctgtctcatgaacccagacagcctgcttagctcaaagtgggtttaccctcctttcagtgcagtctggattttgcctcctggcaaaaaatagagacatccattcatccatttatgttttttcccttaaagtttacaaccctgtgcttctgtttgtctgatatgtaaaaaatgttgttttttacatgtatctagttttctagatttttatcagtaagaaagccattctcatgtaaattactgattttggggcagaagtgaacatccaggaattcgtctttgatttaatactatgtatttttgtcttttaaatgcaattttaagttgcttccttaacacattttatttccttcgaaaacatctatagttcttagtttctggccctccagatattttttttttttttgctggtgtgtttctactttgtgctctttagatgcctacttcttaatagttcatagggcatgccaatttttaaaacatgtctttcaaacctctggatcttataatacgtacctttttttaaaaaaaaaaaagcgtctcttcttccttgagttttcagcattatctattggtcctctcattttttttattatagactatataagttttcattgccactctcgaaaatgaatatctgttcagatcttttgtttgccaacctagtatatgggtttgcttacaattctgagcctttctctccttt

SEQ ID NO: 146 - DNA, 3001 bp, Homo Sapiens
  allele 1501: 99-5873-159 : polymorphic base G or A
  misc_binding 1502..1520: 99-5873-159.mis1, complement
  misc_binding 1481..1500: 99-5873-159.mis2,
  primer_bind 1632..1649: upstream amplification primer, complement
  primer_bind 1176..1194: downstream amplification primer
  misc_binding 1489..1513: 99-5873-159  probe
atttctgcatatctaatcttgactttgatttatctataattttcctttttcaggctatctttgcctagttttgctattacagctatggtagccttataaaatgagtttggaagctctttctcagttctctggcctcttttaagtctttgggacagtttatataattttgagattacttcttttagggttttatagaaatttcttaaatagattttaaactagagaaattaaactacagctttaagttttacaagtagtttattgaggcttacatttcattttgaatcagttttaataatttttactttttgaaaatttctattctatgtagattgtaaagctatttagacgattttgatttttaagccattgaatttattgttttacattattttaatttctagtgtttgcatgtttatattctttatattttcttgattcatcatggcagagttttatcaacagtatttgttttttaaagaatcaggttaaaaaatattttccatagacatatcttatattgattatgttcttacacaaatattttttgtgcttacccttttgttatttatctaactctctgaactaaatatttatcatgcatttctcagcctttttgtggaaattaattttaaaatggaaaatgtccctcaaagtactgctacagttgcagcctccatgttttgagatatcatttgctaatattatcattaatcagtattgtgtcttttgtatgttctgttatttgttttataacacatgaattatttaaatatatattttttgttttccaaagtatgatgcttttggtgatttttcaaaatatgaattcagcattttatggtgtgtgcatgatatgtcatctgtctttgtatttgttgagactttttttgtgtcctatgttggtgattggaattatctatctacacttcaaaattatattcatgtttttatatgtgatgtaacaatctctctttcaccttgctaattatatttttatattctttaattcttttcatgtctgtgtggatcacttgttttaaaacattttgaaaaagggttattataaatagaagatgttaaaattcctaattatgttgtgcattagttggttctgggggataaatttgtgaatttcatttcatatactttggtcttataacagtatgtgtcaccggtttaggatattacatcttatgtatacttgttatacttttttttaaatattattattcattagctttctctattcctagttgcatttatttacttcttaaagtatatttttatgatattaatattgccatggcagcatttttttctttatcatttgcaatacatctttgatggttacactaggtaatatcatcacatatatcatttaattccctattcctctttttaacaatatctaatctgctgtttaagtaattcattaagaattcaatttgaataactctttgttctttcaaaggatgtattttatcccttttccggtatrtgttactctctttcatacctattttttttcttttttaacacttctcttcctatcatgtcatctttttaagactactgatttcattagacttttttagttttcctcttatctcaagttttgtggcgactaaccctgcttattgttacgcctgctccttttctgtatggtggataatttctttttattagatatgatttcctttttcctttacttatttctattcagtatttgaagtattctccaagttggccttgagtttgtatctgttgcttatactagattgtcattgtcttggggctgatttttatattcatatgggcctgatcattaaacagctcttcagtaatataaaatcaaatgaatagaaagcaaggtgccagcatgagaactcaacattttttggaaaaatacccttaccctcagcccccaagtatagacataagtagcctcatcattatattatctctcaacttcatgttttgggcagcctaagttatcttgtcactgagattttagcattgccaaaggtcagggctttcatcccattcatgagtttgatttcctcccaatctttggggcagaaatgtctgatatttcccaagcctctcatcactttagggctcagttgagcaattgccaacctctctgtttcctgattgttagcttcctcttaacttatagcccctgcagattttgctgccaattttagctctagcattattttaaaaagctggatttaatccagagtgtttagctatttgtaggaagattttcatggtaacctacttctttattttattggaatcagaagtctccccttcttctgttattccttatccaagagaccgataaaattcagaattatttctttttaaatcagtgcgctgtatttggtctcattaaaataaacgatccactttgtttattagttgttttgtttgtttttaactccaagtaacttgtcaagctcctatttttttgtgccttttttattcacttaatcaccatagaccatcacaactaccatgctcttgctgatattctcagccctgtatgcttatccaacccttctctacctacattcatagctagaatgaaatttttttaacccatcaaattgttccttcctgcttaaaacctttgatgtctctccaatacctatagataaagatctttaacgaaagcttaagaaatgctcgatggcgtggtcttgatctccctagaaattgcaccttgagattgcttcccattttctttcgtcttttaagaatgctggcttattttcatccctcacttgatcagtgctctctcatgtcaaaaatatattatatagtaatgtttttcaaagtaggttcctagaacagcagtatcaacctcatctgggcatttattagaaaagcaacctttggggtcacatcctagacttctgaatcagaaaccctgtgcgcagatcccagcagtccacactttcacaagccctccaggtgtttctgatacatg

SEQ ID NO: 147 - DNA, 3001 bp, Homo Sapiens
  allele 1501: 99-20977-72 : polymorphic base A or C
  misc_binding 1482..1500: 99-20977-72.mis1
  misc_binding 1502..1521: 99-20977-72.mis2,  complement
  primer_bind 1430..1447: upstream amplification primer
  primer_bind 1921..1941: downstream amplification primer, complement
  misc_binding 1489..1513: 99-20977-72  probe
ggagcaggttgtcaatgtcaaccaacctggattgtttcagaggtggttgctttttagattaaaaaaaaacaataaaaatagataaaactgtatttaataaatcgcttcctttccctagccttctgttttctctgaagcttcattttgtctgtatctaagcagagatttccagacaagttccatttctgggttagaggagatgtccttctccttccagaggtgatcagcagttacatcaaggtgctcagtatgagacagaagtggctcgtcctccatgtccagtgtggacagtgggttgttcccatatgggcccatcataacacgtatttcctaactacaaccaaaaccatacgacctacttaacaaatatcaaacacacaaactactaacaaaagggtttgcaagaaatatgtggaaaaccattcaactcaatattcataacttaaatatatgctgaggagtagagctcttggtatcaaagtgtatattaatgaattcatttatttgctctttcagcaaatatttattgtactccttccattgtcagctattgtacaacatgtgcgaagacttcaaagataagttaaaaattgtggtttaaaattgaaaaagaaaaaataacaaaaacctgaaagtccaatagacaacagttaagttaaccattgaaggacattttgactagatgaattctaagagttctatcttttctcagaatctgtgattccatgaaaatatttgtcccatttcctcaagtagtgacagctatgtagggagtttttaatctgtacttcttgattaattattgttaaggtgaaaccaattttcacagtacattttattaatttattcctcgagtggcttcatgttcatgaaatgtactgtgcacatcacttgtcttttttccccgctgaaaaaattcagtgtcagcaaagaagatatgtcaatttctcaagttaaaattgcagaaaagtacttatttacacgctgctttgctgaaagagcatgataaatccacagacacagaggcagatgttcaacggctgcattctaatatggccatatttgcattaatgaagtgagtggtaatgtcgtctttaacttaagagagaatctcaggggagaaaaaataaaaccctaatttttagtaaatgttgccaccacttaaacttgaacgttttaaagcaagagcattaataattataattagaaaaagagctttgctatttctacatgttcataaaatgacacaaaatactttggttttatattttctttcagcgtcaaagaagaaagtcataaacatcactgcagtttgcatttttatcctgatttcctctgggggttaaaaactatataaactactgtaaatagtaacaacatttatattgatcaaaatgtttcaaattttggttagctatatttgtgaatggtacatggtaggtggtagatggtgaaaataatttttatatgtaaggagtttcaaagatgatctaaaacatgmaggcctaaaacaatagatgaaacactatttcaaaatgtattctctctttgttttcactctccatgttacaaaaatggcaacaaattacgtaaatgccaaggaagccaatatatcatatggtaaatgacaaatcaactgtaacattgaaacaacaattaatagctattatagctattaaaatttgaagcaaaattgtgcatctttaaaaattatacacacatgtgagaggactcatgactgaaatctcaatataccatctatccaagttgagttattttcctttttttttttttttaagataattattcttcttcctacttctgggagggacagtgtatgggaggtacctgtcaggcactgtgagaaccctgggctctgaacagatatggggtatttctctcagtatcctcaatgcagctccaataactaatcccatttcttaatcactttggaattaataagaaaaataatttattttagaaattcacaaaaatatgtaaaacaacttttttctttttttccagaggaataactaaaacaattcttattgaaaagccaaactatacatttttcttcacaagttgtatactaaaaattggcaaaataactccctcagtgataactttcattgttttttcttttttatgttgtttgtttctatggattttatatagttttaaagctataagctattgaaacaatagtgtgcatttatttgactgaaaatattggccacatttttatggtaatatgacctgtccaccagaattgatctaacacattctagagcttagagaaaaatagtgatgacaaagatagacgcagatgcagtcttgtgggacctaagagtttctacagatgtgagttccatgcgcactacattttaagtttgacttcactacattatggaaagacatattgtgctctgtgctatttagggtttcactaaatgttggttgttggtgttcagataactcatccagcctggaaggcaatttcattgaaagggtgcacaatgttcttttcagcagaaacatattagatctctgaggggttttgtccagggttagaccttggttttaagatttgaccactccactatattaaataaagagagatgagtcacatgttaataagcatgtcccagcccatacaaaagcaccataattggttgctatttgctgttctaattgaggtagagactgaatgggaataacgtattttttgtgaggcttaggaataactagatttttgttctctgacaaggtggaggtattttatttgggcattcatcctggctcctatctattatttagcagaaatcattatgtgggcaaaaaagaaacatcattctactttactattaagctgacactagtgtctaatggtactaacccaataaattggtgaatattggtttattccatgagaaaagcatctgttgatgttatgaaataaattaactgtgtgtgcccttcatgaggaaacaatgacaaagag

SEQ ID NO: 148 - DNA, 3001 bp, Homo Sapiens
  allele 1501: 99-20978-89 : polymorphic base C or G
  misc_binding 1502..1520: 99-20978-89.mis1, complement
  misc_binding 1481..1500: 99-20978-89.mis2,
  primer_bind 1571..1589: upstream amplification primer, complement
  primer_bind 1124..1144: downstream amplification primer
  misc_binding 1489..1513: 99-20978-89  probe
aacacgaatgtttcagaagagaataaagaactaataattttatgagttaaaaagtattttgcatttttgcatggctagctaaaatataggtgtaggactttagatatttatttttcaattattcattgggaatctgtattgtaagactttgggatacatcagtatttaaaacaaaaatacttgttcttgtaggccttatatttaacgtttactagaaaaatatcatgcaagccttcttattctatcagtttattgaaaaaaatgagcatttttttacatattacatgtatttttacatattacattaatacatgtttgtcttacacatgtaatatttccacacttttatatctgaaggtatgtgcatttaggatgaagtttcattttttatcctagtaactatatttcagattgtctttacattttcaaactcttttggctaatttcatgttagatttcaatagatcatcatttgtttttgttactagtttctatacttgtttttaaccacaaaatccatgtaaaagaaaaatctcatctttgttatttgttttgtgtttattttagcttattttattcgtatcacctctaatccttattctctctatgggatttttccccctaaactattctaactttaggtaaactagataatataacttataaatctacttaaccaggaacacataaattgctacacattcacctatgataccataaaattaccataaaattgtccaaaggaagaatttgatgtcatctgaagtttcaggaaagtgctcttgaggaaatggacgtgttgatagaaccagagtggggaggaggaaaaggaggcagctctgcaaaggtgtgtgcatgtgggtgcatgcctacacagatgtgcaaaggggcattttaatgcaggtggccatatttgagacagataaggttaagggaacaggatagatgtgggaaattatggaatatttataggtaacccacagtgacccaggtgaggctacttgcaggggatggataagggctatagtgagcagagccatcagataagatagggccttactgcggtaaggtgcatacgtaactcagtggatggtgaagagtcactgcatatttccagacatgaaggatttgaaaaggaaaactgcaggtgggaagaccacctaagagaggtaatgaggggctggcagtgaaaatagaaaaaaagaaaaagagcgagagatgcggaagatgcatcaaaaggaattgagcaacccatttgttttaaacttatagtactgaactagcaattttggtaaggttttaatggggcagagatgtattggaaatgtggccaatggaaaagtgagatggatctgagaagaggtttttcaagatctttgatcctttctaacctttgcgttactgctttgtaatcacaaattcagctctggctagcaggatttgggtttagacacagtggcagttaatcttcaaaatacaagttggttttggttttttaaasagatttgatttgcattttatttttagtgttgaagacattttagttcaattattccgcttgtacaggctgcattaggtagcagttaagtgggcagggtccagagctgagtgatcagattccagctgttaacttactggttatgtaccctttgtcatattattactacttaattgctctgtgtctcgatttcttcatcctccaagtgggcttctattaagtaaggtaatggtgaggatccaagagttaataatagaatgtgcttctaataatgcctggcacctgagaagaatagaatcaatggcgttatgatttctaaaaaggaaaaacgtcaaacaatatgtaaccagatgaatcaaaatcaatttggttgtattttctcgaagttaaaggagaaaaacataattttacattttatttgtgctccctcacccaaaatgaggcataatcccaaatctctctgtataagcatgagggcgcgtgtgagtgggtgggtaggtggcttctcactgcctcgcctgatctagttaattcaactccagaagacagagtagctcaaataggagactgcttaggaataagtgatgtcagaacataaaagttttacagaaaaattgtaaatcactaatattctcattttttttcttgacaagagaataataaaaaattctctttttcatgtttttaactctttttgcttttattcgcttcttttccatgctacatattttcagtgaagagcataaataaaatacagcaaaactaaggaagaagtctttagtacttagcccagtcaggtcttccaggtgatgggcagacttaggcacaatagtattttttttccactagtgcatatcttagaattatgtgatttgggaagttatatactacagaataaggaacatatgtaacgcaatgcaataatcacttagatatttatttttaaaatcctactcttttaaaagctttcatattctaatacagctagtcacactgatgttgtgatgatctgctgttcgtgcattattttccaaaaggatttttccaatattataccatctatgaagcaagtctaggtacaatggagtcacgtctcaaatgatcagttttaaatgatgtgcatagaaatagatactgaaattctttgtaatttcttcaggactaataaagagcttaaggatagctctcaaaaaaatttttttgtcttcacctatttgcaagaccacaatttttctattgattataaggtactaggtttcattactcagtaacgtccgactgtttcgacagcggattgcattagcatggcccattcagctgttgtggagagatgccagttgccatggtgaagattatgatgtcccacatccaatctatccctgagatggggatggcttttgcaaaaccacatgcaaatatttgttttcaaaggtacaactgactctttgtgaagcactggattactagagtggatgtcttttcaatgaatcatcaaatgaggat

SEQ ID NO: 149 - DNA, 3001 bp, Homo Sapiens
  allele 1501: 99-20981-300 : polymorphic base A or G
  misc_binding 1481..1500: 99-20981-300.mis1,
  misc_binding 1502..1520: 99-20981-300.mis2, complement
  primer_bind 1202..1219: upstream amplification primer
  primer_bind 1630..1650: downstream amplification primer, complement
  misc_binding 1489..1513: 99-20981-300  probe
accacgctgtgcctattttacccttgatattcggctacagctaaaatcatatcaaaaaaagtcatatcgattaccctgctatattggcaataacaagatatagtcgaccaataaaattggaaaaatataagagcaagacactgcaaacggcatataaacatattcagggaaaagaaaactaaaacaacaataagataacttgatttttgtccttgaggtaggcaaaaattagcaattgaaaaaatgtgcaactgtccagtttcatcaagtttgtgagaaattggatattgaaaaagggaaatataaatcaatctctctctttccctctctctctctctatttcagtctctctctcacacacacacccacatacacaaccttgaaaggctgtgcagaagcagcactattactttatcttcaaaggttatttccaactccaatgtatcaatctaaagagtaaatttgaaaccttgttttgaaataataagagaagttgaatgtagatttatcataaatgattttaaatgcagtgctatcctttgtcatgatttacaaattctttctcttatttccagatatccataggccatcatagttaacctctgtttctccctgtgaaccaacaacaaatatgttatgtctagtccatgtgtggcctgtaaatataagtaatatttacagaatttgctttgacttggttaagattagtaagaaacttatggtaccagaacatcttaaccagaatacttaggaccctaacactgtattcctcatttataactcttgtgctggttaaatatgaactctcattcatatacatttatttgttgtttatcaccattgacatctaggaggttttgagtgactaagtaccttcaccaatctgtttcccaacctttttttctggattgttctgtaacggaaaggaagaattatgtcccaaatgattgtcctgttgagaatggagatttaaatgtattcagttctttttccaggtctccctttgaaatcctgttttagaatgatactcagccttcttatttcctgttgaaaataataacacatactacctgccacttagcacatataagtgggtgtttggaagaatcttttgactgaatttaatgaaactgctgaattaagtaaaagcttgtatctttttctcaggtagtgactctctgtagctatggaccaccacatatttgccatccctttgctgatggtttgatttggaatgtgtcatttcgtttgtgaaatgagacatagtcaaggtacccatgtgctcaagtgcttagattacaacaatgttttgatgcaaatgtgcaaagtactcagagatcaacactatggtctaataacaggccatagcaaaatagagcaaatgaatcctgtgaaatcagagagaatgcatcaaataaagatgtactacctaaagtgcaaaatctactaggagcactttgacatttcagttcaagttctacagtgtttcacattttttcartctctattgtagtctcacttggaggtgattgcttgatcactagaggaatatgatattattcgtttcagaaatgaagcagctatggtgttctcttgtgaatagcactagatatgaattaggattatgatcttgtttgtgtagaatgtttcattacatttcagatatttgtgtcaggatataacaaagtgcattcatcagcttaggaggtttgctaacttcagcattcaacgtaagtttagttgccccaagtctacaattaaacagcaagacacaacgacaggctttgaattttaatggaaattggcaagatgctgaatagcaatgaaaccagtggggatgaagaattacttgcaaatttgaactgtgtgcaaactagccaacatcaagcaaatagtctttatgatttctatatatgtatgtacatacatatatacacacatatgcatatgtatacacacacctatctgtctgtatatatgtatatacacacagagcagtatttctatatagtcctttaaaaaatgtaggcatcttgtgtctttgcacaacttgaaagggattgtcttctcattgtctagttataaattaaacttgtagaccttatttttttgtctgaagaacaagaaccctatttcctcaactccgtatccccaagcattgaatagtttatgcccataacaactattcagtcaacgctgttgaaaatatgtcttaactgagaatccactccttttccttcacaagctcaaaagcacatacaaaagagcaatgaggctgataaatctgacttttcagaggcatttatcagacagaaacttcccattctgaaaagtatttgtgtatcagaatagttcagactcatggctacactgatcctttaaaagcaaataagctcttaatgccatacctgtttagaaaggtgcagaatggggtatgcactgcatggagagaccctacctcctacccaccctggcctgacatgagtgataggaaaaagtggaaaccttctcagccctgggctacccatgctagacctctgattccagggcggtgaactactgcttttcctcgtgtgtggtttctttctggtgtgatgtcaaagagatccggcaaacaaaagtaaattcatttacagacaattgactagaatttgtgagaaaaccacagaagaatggcaaccctggtagttctttttaaacatatagattccaaactctttcatgaataactcaattgcttctttttatcttaattttgtgatataaactcatcccacactactcctaaaacctttctcgagaattcttatgtctttctatctcattactcttcatttaaaagttcatgtccttttcactcttcaatatcattatcatggagcagtggtcccactgccagggtacatgaaagcggggtagggagggataatttcagtctcagctgctaccttcattctacttgcttttacttccactccgttcttgggttctctcaattctt

SEQ ID NO: 150 - DNA, 3001 bp, Homo Sapiens
  allele 1501: 99-20983-48 : polymorphic base T or C
  misc_binding 1502..1521: 99-20983-48.mis1,  complement
  misc_binding 1482..1500: 99-20983-48.mis2
  primer_bind 1530..1548: upstream amplification primer, complement
  primer_bind 1099..1119: downstream amplification primer
  misc_binding 1489..1513: 99-20983-48  probe
atgtcggatacaagccatttgattgaaggtacagtgtgggctacaaggacgcagaatagaaactgtcagagtaataattctgccaaaaaattagacagtttaaaatgatgtttatgaacaaaaatgtactttaaccacttatcactatttctagtgctgagagaagcagtcaagttttttgtttgcttgtttgttttccaagcctgtgactttgaaagactaagaaaatcttccgtagaaagctaaggtttggaatgtaaattgtaaacaataaggaaaaactggtaatgaaaggaaaatgtcattcatcatcagggcagggataaaggatagttgaagtgagaatgtgtttctggcataagaaagatggagaagaaaaagaaggacgtaaaagagactgatgatacaatgagtaaatctctgggctttattcagaacacctgggtcctggatctgacaaccaatacctgtgttaaaacttcctaatctctcctagtctgtcccctcatctgtcagattacatgatttctcttgaatccttcaagttaattatggggtttacaattctggttttagtatgattgatttttctgaatgataaggtaatcttacataaaatgcatagagattccttattggtattttatcacaggctggcatttatgagaatattattttcctcctggtgccatcagtgcttccatgttctaggtgcaggcatcttcgcggtcgtaagtgccagtgttctcctgaaattagcatctcatctgaatctgttaaccagattgtataagtggagagaaatataatcctttttcatgttgattttaaaaataaaccaggaaaattcaaggttaccatgttttgcaaatattagggctcacgcgaatcacctggaaagccaagaaaagtacagattccttggatcaccatctagatattttagttcagtgggtctaatgggaggcccgagaatcaacagtttgtaagggtcaccctccctcacttctgccggttattctaaagttactatttcaactgtggacaatcacacaacaagcattgctgcaatggtatctgggggagacggtgataacgttagaccaaggtgatggtaacagagttggtgaaaatcagtaaatggactactcaggcattgaaactaaatatttggattttctaactgttctaccactaagctgaagtttacagaagtttgaaagcagaccagcatacttcttcacttaagcaacaactcagaacttctggaatagggactggtcatctctgtgggctggcatcacctctcctacctatccatacaggataaatatgtatatatgaaagttctttaatcaaggaaagaaagataaatgctatgtattcctcagtaagcattttcaagatcatcaaagtcttatccactctacataagatagtgttctgatatcatatctttcaggagcattttcaaatgagcctcttctacaaaggtggtttyacctgccctcctctgtgccagcaggcttctcttattgatgtgtcctgagttgtgtttccgtctgtccttagctttccaagagcacccaggcataaaagcatccgagcaacccacctcatgcttccatgaactgttcatcttcttgcaggatctataattctagcaaaacaaggtggaacaatgttattttcctcttgaaatttattcctctcttcgttgctcaagtttagggtatagaaatacaactgctctgttttatcagtatggtacctatcatccttcagagtctttctaatcttccctaagagtaacacacccaaagacatacatgtccctcacctgtaagtacacactcatggagtattgcgtgaattcattgcccatccctagcacctgtcctgtctctgagtaacacctttacatgccgattctcataaaaatgttcactatttactcagacattggcagggcttcctattcctcctcccccaggttttatgtttatttgttttgttgttgtttgctaccaggcagtgcatgtgcttaatcaaataaactgagctctagtggccatcactggccatcaacatccattgcaggcagaccaagggccttggcagcatttgagggttgctcatcctggggaagagcctttcattctccctgggagcactaaggcaaagctataccaagttcatctagttacacacaggtgcccctttaagaatggaaattattttattctttatcttttattcttcatctctctgaacaggttggtttctttatcataaaaagtatattaaacttgagatgattattaatgtctccaattattataacaatctatgacactatgcatgtttttctgcacaaacaatatctaacactttttggggatatatatacacatagacacacatatataattctcatatgtatgtgtatgtttcattggaattatgcattctcctcaaattatatatacatttatcccacgattatgagtgtttctgtttatattaataaaatgttaaataacagttttacatttgcacatactttaaagctttacttgtcatgctttaacaatatttctttttttaatcaagcttttctgtgacttctttcacattagagttcagttggatatatctgccaggttgaaatggctattatcctttcttggtatcttggccaagataatttatagtattaataaagcaagtatgatacttcagctaattttccccctaatgctaatttcaacatccagcattcgtgtaattcccatgacattgaatattgatgcacagaatgtaattggttatgtccaagaatgccattatctacttagggtcactaactggaaaggaaaagaatttgagaaacaaatacagctagtaaactgcatttaactagttataaatcatcttttggacaacagaaattatggaatatccaatttttttatttgttaggttgaagctagataacaga

SEQ ID NO: 151 - DNA, 3001 bp, Homo Sapiens
  allele 1501: 99-14021-108 : polymorphic base A or G
  misc_binding 1482..1500: 99-14021-108.mis1
  misc_binding 1502..1521: 99-14021-108.mis2,  complement
  primer_bind 1394..1411: upstream amplification primer
  primer_bind 1853..1870: downstream amplification primer, complement
  misc_binding 1489..1513: 99-14021-108  probe
  misc_feature 267,299,336,617,679: n=a, g, c or t
caacatggcaaaaccccgtctctactaaaagtacaaaaattagctgggtatggtggcaggtgcctgtaatcccagctactcaggaggctgagggcaggagaagcttgaacccaggtagcagaggttgcagtgagccgagatcgcaccactgtactccagcctgggcgacaaaagcgagactccgtctcaaaataaataaataaataaataaataaaataataataataataataaataaaaggcttctatatgcacagaggatttgnttcacatattgattctcttatgtggtcttcanttcacaactgtatgaatctgtagcatgaaatacatanttggcaagtaaagattctataaaggaaagagtaggaaggtataacgaaccaattctgagatttccctaagcaatcagttcacctgcttgcctccatggaggccatcattgtcttctagcacaatttgtgagagacagcaaggcatctttttaccactattaacctaatctatggcagtgttcccagggaccaatgttgtcagttgtagagtaatgccatttagaggctggatgggtttacagttgcagccaagcaagggtctgcattgaattgacccaaanagggaattttcaagtaatttctctatctttgtatgtgtgagttttttagtagtccattcaantttcattagcttgtcaactctaatatctgacaactgaaatataaagtagggaggagaaagagcagaattaagagaaggaatatatgtgccagaggagagtattatcattgtcctgatgtagtcatgatgacctaagtcatcctttgatattgctttcatataaaggttgtagaatatatgaaccaaatcaaaatgggacaaggagagctgcttgctcacaaaatgcctctgatctattgtgtgcataaagcatgactttatgacaaacacatagagactctagatgggggaagttacagtccttgagtgattttcgtattcaacccagtgggatcactatcatttagtggtatattaaaatgctaattctcatccaaggtcaaattcaactccatacaagctgttttaaaattcagaattggttgctttatgaaaagtaaatttgagactatttggaaataaagactatttgaaaattttctggcttccttaacttcagtacctcttgccattgtgtcacagcttgggtgtggtgggggaggtgcaatcttctgggtagagaccaggaatcccactaagcctatatcgtatgggatagccctatgacaaagaatgacatggcccaaaaggccaatcatgccaagcttgagaaactgctcagaataagcagggagagtgaagaaacaagctgatgctcaaactagtgaatctcattttgttgttaatcgccccttttctgcaacacttgtgggttagggaaaataattctaaagcaagagcaaagacagagttgggagatcaccagtgaggttcaattttccrtcacattcactctgctccacacctcagataatcatgtgcttaactgcgaaacttgcttgacaattacagaacactttctcacccattactaccttgatcctcacaattctgtggggtagtaggagcagatgctgaaattgccatacgcaaatcagtgaactgaagcttagagacctccagcaggggcagagggtcagcggaaactatcccagggttcagccaacaagaaagtatattggaatcagagtattaaaataagaataataaaaccaactaaaatttaccgtgctttttatttccactcagtgccaacaattcttaacagtgtcagtgatggatccctgtgccccaggggacagacttcttactagcttctgccactttggtcagctgctgttctggggaggttaactttcttacttcaaattcacactagagaggaaaaggaaatgcatacatataggaccaaatttcactcctgatgtctccacacacaaagctccttcaccatgccagtctcaatctgctgctctggggaggttaagttttgtttgtttgtttgtttgttttttgagacagagtttcattcttgttgcccaggctggagtgcagtggtgcaatctcggctcactgcaacctccgcctcccaggttcaagccattctcctgcttcagcctcccaagtagctgggattacgggtgtgcatcaccacacctggctagtttttgtattttcactagagatggggtttcaccatgttggtcaggctggtctcaaactccttactctcaggtgatccacctgccttggcctcccaaagtgctgggattacaggcatgagtcaccatgcccagccaggaagttaagtttcttacctcaaattaacgctagagaggaaaaggaaatgcataaatacaggaccaaatttcactcctgatgtctccacacacaaagttccttcaccatgcctgtctcaatcttgtcattaaagtggtatttccttattaggaaaaaaagaactaggtccttaaaatactgttcattccatcccatgggttgagtacattacatattgacagtggtacattccagccacctgagacaaccaatcttatgccaatcagtgctacagagagcaccccttgccttacagctggcctaaccacagctggggatgactgactggagaatgttgtgatctttgactttgtcacaggtaaaatggtgtttctaactaatcacaggtctctgtgctgtgcctttcacttcatcacactctattctctctaattccaaccctgccaaactcattaggccaaatttgcttacttctgtgcattctacacacttccaacaaaccctatgtttgcctttccttgtgatgataaagagaaatggcagttagtggtctgaaagatggcgtctgacctttttatgatggggctgaaggctggatgctggaggcagggtgtgtgtttggtgcagcactgatattcccta

SEQ ID NO: 152 - DNA, 3001 bp, Homo Sapiens
  allele 1501: 99-14364-415 : polymorphic base G or A
  misc_binding 1502..1521: 99-14364-415.mis1,  complement
  misc_binding 1482..1500: 99-14364-415.mis2
  primer_bind 1798..1816: upstream amplification primer, complement
  primer_bind 1344..1364: downstream amplification primer
  misc_binding 1489..1513: 99-14364-415  probe
aaagatgcattactttcaaaggaaaaagcaacaagactgataactgaattaccaaaacaaatggccaaaccagatgatgatgaaatggcattttaaaaattctgaaaaaaattgtcaaattagaattctgtgcatagcaaaaatatcctttcatttgaaggcaaaaatcagaacttttccagacaaacagatactaacagaagttgtgaccagaggagcctatcagaagaaatgttaaagaaaaaatttcttcacatattagataaaagatcaaaaagagaaagagaaacactgaagtcaagaagcaaataaagaaaaacaaaaagcaaatatagggtaaatctaagtgaaaaaattccataaaaataagatgaagttaaactaaatctagaatgtaaatattatgatactagaatagcatggatacagaaataacataaagacattaggaaaaggaggttacaaatcaatctcatgaactttgaacccagaaatatacaaaaaaatttatataagtagatttagtcaaggaatagagggttgctttatcattttaaaatcaaaataaatagtacctttgacagaaaaaaaaattatctcaacatatatactctatattagacaatatttaaaatcattcataagaaagaaatagaaagtaacttccttattttgatgaaggtaatctaaactaaatttatatcaaacatcatatttagaagtataatattgaaaggtttcatcttaaataacagaacagagagaggttctccaaagatagtaagtttactcaggaacacgcacagcaatgcagaacatgtcatagtaaactatggaagtactcagggtggcaaaagaagacaagggtttttaaaggtaaagtgaggagggttacatgagttattttgaaacagctattcttagttgcaaggatcaaaaacaagtctgacattagtccaaggttagacaagcagatatcctcacagaagcgtgtgcatgcacgcgagtgtgtgtatgtgtgtgtgtattaggttgcaatggctttgtatatgattgtagttttgtcaaagtcttattatcaggcaattgtgtatgaaaatgctttcttcatggcctttcctggcttcattatgtcagtgtctgacacaagtgacttcattttgattcagacaactttcacatttgccccttttgatcaaaatacgtctctaaaaccattgctgactaatcattctgtggttagattttcatcatccatcagtgccaggatgaacttgttctgggtaactctgatcccatgtcagagggaagtgattgctgattaggagtcagtatgaaaccctttagccacatttgagcatcaggagttctgtggggagtgttcgttgttaagtccaacttcatcagtttcatagacaagggttatcatctcaaaactctgagccagcattattctctcaggagttgtacttctgctgaaatttgacaagcaataagtacraagtttataaagaaaaatacaaagtaaaattaatagtaataggaaaattctagtttatgtaataatattgagccaagaacctaggcttgaaagcaactgactgaatcagccaaatgaccatggggaattaggtaagtcctgttgtaactatgtggcctattttcttgagtatttgcatcacaacttgcccaaaggggtttatccaggtacagcatgtattattggcaatagcacaaatatctccttatttaaccaatagagaatctagagcaattctatcatttcgtatcttatagctgggttgaattaaaacacagaatgagcaacagttgtactagagatgctgttgaagttacccattgggcaggctaagggcttatctgtcagggcatgtaaatatttaggatgggcatgacagatgcaacattttttacagcttcctgcagaagctattgattgtgaaattttaactataccattatcctgccaagtgaaaaaggtaggcacaagcaaggaaaaattaagaggggcaagagtctcattatgataaggaatcttatttcaatgtcttgggaagaatttttcccagcatgaaattgtcaacttctcaccctggtttgtggtttgaaggtctctggttacagcattcgacagtttggtgaacttgccgtgtggctcaaacatcaggcacaagtcttgtcccttgaaatttacatcaaattgtctagcttcattctacgcgggtttagaaaagggtggttttgttctcactaatttcatgagagaaaagtggattggaggaacctacaagtgaagtggcatcattgtctggggtaaatacctggggttggtcattttgtgctgagaagattaacaacatggacacgcacacatggaatgggttaaggagcggaaagtttaataagcagaagaaaggggagaggagagcagccgtctctgtctgtctcttgccagagagaggtatctgaaaaggaaagacctgctggtggcagagtgcactggattctacaggcaagcttgagaaggcactgtctgatttatgtagggcccacagattgattggatcaggtgtgacatttacattgtgtgtgggaaggctggtcgccccaccctaatcttattatgcaaatgggctttccacttggccagaaccatcttgtctgctccttactgtacgtgtggctggcaaagagagggtggagctgccattttgagcctgcctattcccaggtagtttcttcctattggcacaactgccagcaataggctgctcttcgtaagaaaagaaaatgatttgggggctgcttttcattaaaaggaaaaccttactgaggactcccatattctcactatctgcctaagtaatttcttcttaactcctatatcagaagaattcaagatccagtctagactacagatagataataaaaactaagaaactatgcacagggccaacatctaacaagtatattagagttt

SEQ ID NO: 153 - DNA, 3001 bp, Homo Sapiens
  allele 1501: 99-7308-157 : polymorphic base C or T
  misc_binding 1482..1500: 99-7308-157.mis1
  misc_binding 1502..1521: 99-7308-157.mis2,  complement
  primer_bind 1345..1362: upstream amplification primer
  primer_bind 1814..1834: downstream amplification primer, complement
  misc_binding 1489..1513: 99-7308-157  probe
cctgcatgacatcatttcattttccaacaccacacattgactagaatcattacaatcattttactaaacaggaagccgagacatattgaggccaagtaactttccaatggtgaaccagctaggaagaaatagattcaaaatttacatccattctcattaacctcaaagtttgcacaactaaccattaaaccacattgtatcttaatgtacatctaatgcagcaccggaaggctatatgagaaagtaaatttcttttgtttgaggaatcactactggtttgccagaaatttgcttgggtgacagtgctccgagacatctgttactccctgtcattagcccaaccatcataattacacacccactgaaataatcacaagatgcttcagggctgaccttgcaatgttgttagtcactctgttgctgaacttgtatcttgttaaagaaattctgagttggtggatgatgggggaaagaaaaattagtatttaggatcatataatttcagagctgtaattaaagataatctaatgcaatgattcataatattttctagctgacatgatggggtcacgatccctttgagaatctggtgaaagacatggcaatacagtgttgtgctggctgaccttcaactaatctctacttggaggtagtcccaggttcagcaggaggcaggggtccctccttcaacgatattccctcttcctataccctggcagctagaacaggcacacatcagacacccttggtcagggcttttattcttgagggtgaaagcaaaggcacaacgtctgtgggcagtgtggcaaatgcaacagcatagcaattctgggagccttgaagctcagcctgcagtggctgacattcagaagtgatggcagcaggaactggttcttggcagtgccttgcttccccaggttgctgcaggagctaattgttcaaagttgcattctgagcctaaagccttctaataaaatattttttatcccttttaatgaagttggttttgttgtttgtaatcaagaaccataactggcagaacacagatctatccctggaaaaatataccaatacacattttttttggtaaaatgtcagaaggatccatgacttccttcaatttatttaatagatgaggaaactcaagcatgctggggctaaatgatttgcccaaggccagctctctatctattagtagtgttggttttagaacctagattttctgaactccagtcacctttcaatgtgcataaatgctctaatctttttcatgggtggatgtgcaaatgattccaataatgcaggctgtggggagaaagaggcaaactgtagtaccatcagcagtgtggtctggatatggtgaactgttccttcacacacagatgtgggaagccatgatcatcagttgcattattcctgaggggcaatgcattccagttacatagaaccagtttctacgtttcagggtatatgtattcatggtgacaaatttattcacatyttaagtaattttaagtaattcacattttaagtaattttcctgaatgtgcctcattggcttctgtgcctcttcagaaaagatgaactaaacactggcatatgtgttcagatttcaacattccgttgttttcattgtggataatttctgtcccatatttttgtgtaaagttagacaataaagtgttaatattctggcgtcggcacattttctttcctgataaataacaattcacatatctttttaaaatatcagagaatatagtaaccaatttccaattcttttttcaccatgtatctattggagttttaaaatgactaatactaaggcaactatgagatgaattaaccttttgcatgtaaccctaatacagtttataagatacagtggcttctgataaaaatcaaaaataacgtattaggatgggcaccaaaaatagaataagacgtactgtttggtagcacaataggatgactacagtcaataataacttaattgtatattttaaaataagtgaaaaagtgtaactgaattatttgtaactcaaaaggataaattcttgagaggatgaataacccattttccatggtgtgcttatttcacattgtgtcctatatcaaaacatctcatgtctcccacaaacatatacacctactatatatccacaacattttttaaaaagttaacaattaaaatataatgcattaggaaaggctaatttattgcagacagagaggtaaaaaagagtaaattcttcatgcattccatatttttttgggtttttttttagagacagagtcttgctctgtcactcaggttggagtgcagtggcatgatctcggctcactgcaacctccgcctcctgggttcaagcaattctcctgcctcagcctcctgagcagttgggactacaggcacgtgcctggctaatttttgtaagtttattattttgctgcctcagttcacaacttctatttagccactaccacaaatcactaccaattttgtttcagtcattatcatatacctatcaggtaaatttccaatcattcttcaaggtccaaggaaaacttcaccaaatctgtgacattggcatcctcctactcacacaatttcacaaatacaataaaattaactatgcttcttatgtgtcctcataatttttttttttttttttttttttttttttttttttttttttttttttttaggcagagtcttgctctgtccccaggcttgagtgctggcagtgcagtgttgcaatcttgggtcactgcaacctctgtctcctgggttcaagcaattctcttgcctcagcctccagagtagctcggattgcaagcatgcgccaccacacccagatgattttttttttctatttttagtagagacaggattacacctgtcggccaggctggttttgaactcctggcctcaagcaatccacccgccttggcctcccaaagtgctgggatcacaggtgtgagccactatgcccggcaa

SEQ ID NO: 154 - DNA, 3001 bp, Homo Sapiens
  allele 1501: 99-22310-148 : polymorphic base G or A
  misc_binding 1502..1520: 99-22310-148.mis1, complement
  misc_binding 1481..1500: 99-22310-148.mis2,
  primer_bind 1630..1648: upstream amplification primer, complement
  primer_bind 1183..1203: downstream amplification primer
  misc_binding 1489..1513: 99-22310-148  probe
aaatttttaattttagtgaagtccagtttattaattatttcttccctgaatcatgcctttggtgtcatatatgaaagtcatagcacaacctaagttcatctagattttctcataggttaccttctaggatttttataattttgcattttacatttatttacgtgatccattttaagttaatgttatgaaggacgtatgatctatgtttggatttatgttttgcatgtggacgttccagttgtcccagtaccgttagttgaaaagactactttttctttattgtattgcttttgttcctttgtcaaaggtcagttgactgtatttatgtgggtctatttctttgctctttcctgtgctccattgatctatctgtctattccttcaccaatacttcactgtcttggttatggtaactgtatagtgagtcttgaggttgggtagtgctagtcctctcactctttttctccttcaatattgtggtggatattcttggacctttgcctctccgtgtaaactttagtatcagtgtgtcaaaatccaccaactaagtcactgggattttgattgggattgaattgaatctatagatcaagttggaaataactgatattctgacaatattgagtcttcctacccatgaagatggagtatctcttcattcatttggttcttctttgatttttccattagagccttaccgttctcctcatatggaccttgaacatgttttgttagtaaatgtacttttaaacatattttcttcccactgttttatgtggacattcatcaagctttttttttgcttgattcagtcttttcagagtatgattttaaggtatgtattatttttaaaataatagatattttatcttatgtacagttagagatttccctgttgacactaaaatatttacatgttgttgatttttatgttttgcttttatgttcgttttagaaacaataatgcctactctaaattatgaaaacaatgaaatacaaatatgggcatcaaagaggaaaatgaagaagctatttcaagctgtcaagaatatactcttagctctgtattcaaaagtacttcatttgtataaaaaaattaaattcaaatccacactttaaaatttttaaaaaagtaattgtttctctcaaaatacgtatggtcaaatgaccatttttttccttctgtgtagttgcttattttagagagctttgtcccaacagggtagcagagagataatgattctactattgtctttaaattcttacccgcttctctgccagtcatcgaactactccctctactccaaaacttggtctgctctgctctaaatcaatgagatattgctatctgtctgatgcaggttacattccagtatcttatctttcccagtttgtattgcaataatattggggtaaaatattgcatgggtttacaaaagggattcagtaaaatacaagcacacatttagagcttgttcttggatttgatttgcattgtcartttggtgccttcaggagtcatttcacattctttgcttccacatatcagcttttagtaaagctttgctctatatcggtagctttcaacctgtgctgcacttctgaaaccctagggagcttttaaaaaaagaatgatctcgtatcacaccagaccaattaaatcagaatctctggaggctggcactctggcatcagtacttaaaacagctccccaggagattctcaaaggcagcgatggtgacaaaccacagctctgtacaatagaacaggctgctcctttataattattaatcatagtgtatattaattcatcatcacatacgtggctagaaaaaaatttagaacaaaaagatatgtgatatgtaaaggcctacgataattcagacttctttgaggagagcttttattttattgttattcttattttatctcttgtcaatataaattgagagaataaacagacaaacattacaaattagtgattaattgcatttaaagcctagttaagactatttaagactattatgcataatacaggaaaactacctttattatttatagtgggtgccttctgaaggatctgaaggagaatcagttctatgcctctctcctcattcccaggaggtgcctggcattccttggcttgtagacgcatcaccctaatctctacctctgccttcacatggtgtcccctgtgtgtgtgtttttgccccatgtgtctcctctttttatatggatgccagtcatgagatttaggcccaccctaaactactatgaccttatttaaagtaaacttaactaattacatctgcaaagaccacacttccacataaagtcatattcagagttccaggtagacatggatttttggaggacactcttcagcccagtactgcactcatattactcaacttctccactgcttttgatgctgttcaacactcttctgagaactccttcctcccatatcttctgtgtctattttgcctgttttgcccccttctgtcataatgcccctaacaacatattgcaagagtctgctaaataaatatctgcttcctcttattgtctgtgcaatcctggagggcagggagttgacttattcaggtctctatgtgaacaccaaccaatttttagctcatggaagcccgtagtaagaattggaaaaaaggaagagaggaagaaaaagagaaggttgtgacttctgcctccatggacatcatgaggaaacacacacgtgccttgacttgatggacctatacaattcattttttaaaatattggcatttcatactcacatcaaatatcttgcacctgcatgatatcattccagctagtacagtttctggttataaaattgtagatcaggattaatgattattaagcccggttttccaaattattgaggctcacaattttgagaagtgtgatttccatagatttgtttaagaagtaaaaggctggccaggcacagtggctcatgcctgtaatcccagcactt

SEQ ID NO: 155 - DNA, 3001 bp, Homo Sapiens
  allele 1501: 99-15232-291 : polymorphic base G or T
  misc_binding 1481..1500: 99-15232-291.mis1,
  misc_binding 1502..1520: 99-15232-291.mis2, complement
  primer_bind 1211..1228: upstream amplification primer
  primer_bind 1677..1695: downstream amplification primer, complement
  misc_binding 1489..1513: 99-15232-291  probe
  misc_feature 2775,2807,2844: n=a, g, c or t
gtcactgggattttgattgggattgaattgaatctatagatcaagttggaaataactgatattctgacaatattgagtcttcctacccatgaagatggagtatctcttcattcatttggttcttctttgatttttccattagagccttaccgttctcctcatatggaccttgaacatgttttgttagtaaatgtacttttaaacatattttcttcccactgttttatgtggacattcatcaagctttttttttgcttgattcagtcttttcagagtatgattttaaggtatgtattatttttaaaataatagatattttatcttatgtacagttagagatttccctgttgacactaaaatatttacatgttgttgatttttatgttttgcttttatgttcgttttagaaacaataatgcctactctaaattatgaaaacaatgaaatacaaatatgggcatcaaagaggaaaatgaagaagctatttcaagctgtcaagaatatactcttagctctgtattcaaaagtacttcatttgtataaaaaaattaaattcaaatccacactttaaaatttttaaaaaagtaattgtttctctcaaaatacgtatggtcaaatgaccatttttttccttctgtgtagttgcttattttagagagctttgtcccaacagggtagcagagagataatgattctactattgtctttaaattcttacccgcttctctgccagtcatcgaactactccctctactccaaaacttggtctgctctgctctaaatcaatgagatattgctatctgtctgatgcaggttacattccagtatcttatctttcccagtttgtattgcaataatattggggtaaaatattgcatgggtttacaaaagggattcagtaaaatacaagcacacatttagagcttgttcttggatttgatttgcattgtcaatttggtgccttcaggagtcatttcacattctttgcttccacatatcagcttttagtaaagctttgctctatatcggtagctttcaacctgtgctgcacttctgaaaccctagggagcttttaaaaaaagaatgatctcgtatcacaccagaccaattaaatcagaatctctggaggctggcactctggcatcagtacttaaaacagctccccaggagattctcaaaggcagcgatggtgacaaaccacagctctgtacaatagaacaggctgctcctttataattattaatcatagtgtatattaattcatcatcacatacgtggctagaaaaaaatttagaacaaaaagatatgtgatatgtaaaggcctacgataattcagacttctttgaggagagcttttattttattgttattcttattttatctcttgtcaatataaattgagagaataaacagacaaacattacaaattagtgattaattgcatttaaagcctagttaagactatttaagactattatgcataatacaggaaaactacctktattatttatagtgggtgccttctgaaggatctgaaggagaatcagttctatgcctctctcctcattcccaggaggtgcctggcattccttggcttgtagacgcatcaccctaatctctacctctgccttcacatggtgtcccctgtgtgtgtgtttttgccccatgtgtctcctctttttatatggatgccagtcatgagatttaggcccaccctaaactactatgaccttatttaaagtaaacttaactaattacatctgcaaagaccacacttccacataaagtcatattcagagttccaggtagacatggatttttggaggacactcttcagcccagtactgcactcatattactcaacttctccactgcttttgatgctgttcaacactcttctgagaactccttcctcccatatcttctgtgtctattttgcctgttttgcccccttctgtcataatgcccctaacaacatattgcaagagtctgctaaataaatatctgcttcctcttattgtctgtgcaatcctggagggcagggagttgacttattcaggtctctatgtgaacaccaaccaatttttagctcatggaagcccgtagtaagaattggaaaaaaggaagagaggaagaaaaagagaaggttgtgacttctgcctccatggacatcatgaggaaacacacacgtgccttgacttgatggacctatacaattcattttttaaaatattggcatttcatactcacatcaaatatcttgcacctgcatgatatcattccagctagtacagtttctggttataaaattgtagatcaggattaatgattattaagcccggttttccaaattattgaggctcacaattttgagaagtgtgatttccatagatttgtttaagaagtaaaaggctggccaggcacagtggctcatgcctgtaatcccagcactttgggaggccaaggtgggcagatcacctgaggtcaggggtttgagaccagcctggccaacatggcaaaaccccgtctctactaaaagtacaaaaattagctgggtatggtggcaggtgcctgtaatcccagctactcaggaggctgagggcaggagaagcttgaacccaggtagcagaggttgcagtgagccgagatcgcaccactgtactccagcctgggcgacaaaagcgagactccgtctcaaaataaataaataaataaataaataaaataataataataataataaataaaaggcttctatatgcacagaggatttgnttcacatattgattctcttatgtggtcttcanttcacaactgtatgaatctgtagcatgaaatacatanttggcaagtaaagattctataaaggaaagagtaggaaggtataacgaaccaattctgagatttccctaagcaatcagttcacctgcttgcctccatggaggccatcattgtcttctagcacaatttgtgagagacagcaaggcatctttttaccact

SEQ ID NO: 156 - DNA, 3001 bp, Homo Sapiens
  allele 1501: 99-6080-99 : polymorphic base G or A
  misc_binding 1502..1520: 99-6080-99.mis1, complement
  misc_binding 1481..1500: 99-6080-99.mis2,
  primer_bind 1572..1589: upstream amplification primer, complement
  primer_bind 1061..1081: downstream amplification primer
  misc_binding 1489..1513: 99-6080-99  probe
gaatttaaagaaatgaattttagtaatgggtttagtatatattaaatcatgttcatataacttaaaaatattaattttaagctatttactgaagaaaaacatgaccactcagtggaactttatattttacgatttctaaaaatattataggttatttttctaggaactgctgttaattttggccattactgccatatactttggacatatataaagtgttttttggtaagtatctgagattacatttaatatctacatgtagcacactttacacaagctaaattctatcgtatttggcattttttcctcaattcagctgtattttcagagaaaacacacaagattacagagctatttctatgcttaatagaatactgtctaatgatttctgcatgtagcaaaatccaactttttggattaacatggctacatggtaatcacccactaaatatttacaacatgaatttatctgtgactcacttgatgtaccgtgattgtgtgcgcatcctaagacgtgattcctgtactatggttgagtaattgtcatggcaggtttgcccctctagtgttggcttctcgttttgctttgtgctgcttttctctgctatccaggctgccattgctatttttattttctacttctgatggttcaggaacatgaaggcaagataaaaagaaagtatgtgttgccttactgccactattctatgatatgagtcaggggtatggaaaagctgaatttttaaggagacagcaaacctcacagattcaggggatttaatttcccctcctcatatcccagaaggtctaagttactagttacgttaaacaaaagaaataattaaacaatggagaagatgctatagaaaagtttcccttttcttttctttttaaatatacttcttatatgcagtcctaaaaggactttctctcttcttatagcttaacaatcaaacaacagcttagggcagcatttggcaaactgtaactgctggttaaatctggcctgtcccctatttctataaataaagctttattggaatgcagccacactcattcatgtgaatgcgtattgtctgtgactgctttggcaaaatagtggtggagttgagtaattaatacaagcgcttttcagccttagagcctaaattatttactatctggccaactcactttttggtttaaggtaatgaaattttaatttgcacacaataatgtacatgttttaatatgtgacaataaaggttttgctgcatttatgcagtacatttttgaaattaaaaataaacttgtaatagaaatatagttctaaagagtttcaccatcttgtagatttttcaataattttttcatataaagtcaatacatctttatagaataaaatattttagaatctagtttataggaaatagcataaacatctgtttcgataaacttcccctaataaagacataccttgaacacgagctattgttttgcatttgccaacttttccatttcrtaattgtattaaattgctagagatggctttgtaatcaaagacattagaatattcagttgaatatagcatgggtttcagggacacatttttgttgttgtagtggtttttgtttttaattctctgctgctaggtagcactaaatccccaagggactcaaagatgagaaacaggaaaaaaatttccagctgtgaactgctgctaaagcagagaagccctgtctgtgatattagttcgtttatcaaaatgcttgcgatttggccctagaaaaagggaccgctggcagtgttgtacataagtggtcctgcttggtttgcccatgtggtatttatctcagtcccttctgatcagggccagaaagtctacccaacaggaatattctatattgagtagcacctgactactgaccaaatcagatgttttcctttggtagatttaataaccgtagagaaagagagctgactgcaaagtgctaggaatgactagagactgagagagagcacagatgcttacagagagcctcagtagttactggcgggaaagagaaccgggggagagagacagtgagcaagaaaaggaggagagacaaagatggagaggaaataaagtaaaaacagatgaagcaaaaaaagaaattgagtcagaagaatgacagaatgaatatggtcagaagccaactgcacccatttatgaggacataactgcttgaattgctgatgtgacattggaagtttgtgtgtgtgtgatgcagtggcattccaattctccctgaaggtatttacctatctcccatatatttccatgtatctgcaagaagccttatcacctatgacagagctacaaacatcagagtctcactaatatatatatagctaattgattattttcaaaataaaatgtgaagggaataaatcacacaacagccctatttatggtttagcaaatgatctcaaactcacatatttagggggtcaggtgcgtcaatgagtgaatcagtttgggtgtaggaagtgatgggtcaggttgagggacagaagaggctgtgcactgctggtgggactgtgaattagtgctgccattatggaaaattgtatggaggttcctcaaataactaaaaatagaattgccatatgatccagcaatcccttttctgggtatttacctaaaagattcgaaatcattatgtccaagagatgtctgcactcccatgttgattgtggcactatgtgcaatagccaacttatggaatcagtcgaagtgtccatcaacacataaatagataaagacaatgtggtacatacatatacacaatgaaatactattcagccttacaaagggaagaagttctgtcatttgcaataacatgaatggaattggagaacattatgctaagtgaaataagccaaacacagacaaataccacacattctcatacagaaaagttttccttttcttataacttatatgtggaatgtaaaacacttttattctcacttatatgtg

SEQ ID NO: 157 - DNA, 3001 bp, Homo Sapiens
  allele 1501: 99-15229-412 : polymorphic base T or C
  misc_binding 1502..1520: 99-15229-412.mis1, complement
  misc_binding 1481..1500: 99-15229-412.mis2,
  primer_bind 1893..1912: upstream amplification primer, complement
  primer_bind 1419..1437: downstream amplification primer
  misc_binding 1489..1513: 99-15229-412  probe
gttttgaatttcagaaagttgtgtaacgcttccatgaatttttctttatcttggaaaaacattgccatgcaatgtattttataattactttcagaaatacagcgtttctaattgagaagtttgtgaacgtggcctgaacattctagctcatgtgcgtaattgatagcaatgaattattttacaaggtaaagatgtttcccccttggctcaataactattaatatcaaatgaaagcacacactggcatcagggggaacacagcctcctcacccttccaatttcatttcacattacctgccaacttccaggaaatcctttaggcatcattacactttttccctaggccccctatcctcccttaagacctccactctgctatactaacctgcacagggacagggaaataactctaagtgcatctcttttctttcctaagatatgttgcttaaatgtaagggaaagctacttggcaactctaacacacacacacactcaccccagaaattctcggctcttcacaagagtgtgttttctccttatggaagagttgatgtggttccatttataaaaatagcagctatttaaatgggaaaagctttttctcatatcatctgtgggccaaatgtttttctaaaaacatacattctctttttctagcagagaagacaaattctaaatggattcaaggttcatcaaattgctaagttttctttgggttaatgcatttgacaaccaagttcacagaagtgccaaaatgaaaataagtaaattaagaactgttctatctaatttctttattagaacacacatttttgtgtgtttttcatgtgtatgcattatatttataaactgatgtgattaatatataaactgtgttaatctgcaattatttttatttcctacatagaattttatatggtgatttttaggaagttggaacacatagtccatataaattgtttcttaagctctgctttctctacttcagggaagcaaaaagagaagttcatatctcttctttccaatccttttttttttttttttttgagatggagtttcattcgtgttgcccaggctggagggcaatggcacaatctcggctcactggctaatttttgtatttttagtagagacacggtttcaccatgttggccagtctggttttgaactcctgacctcatgtgatcctcctgcctcagcctcccaaagtgctgggattacaggcatgagccaccgtgcctggccctttccaatcctttttaagctcatgtattcatcaccaccttcataagttccaatttctctagcttatattcagctgaatatgaccttgaaattcaaagattcactctttatccaatgcaagattctgtctatcatgcatattcactgctgtttaaacatttccactagtgatgacatcagactatgcaggggatggggtggtgtaggggttgtggtaggcagggcttctaaaccagcaagactaccttcattcctytggccgtattaaatacctataagagctaacgaaagcattgagattgctatggatgaattggttcaagattagttcattatccctgtccgcctctagcaccaaggctgctctaggctttaagcctcccagtgaaagactctggatctcgactggtttccaagggtagacagaaaattacaggatacattctaattattaatattacagatgttgtccttacattgagacacatctgcctggacagtggtcaccatctgctcctctggaactacatacaaaaatgggtccaatcccttaaataaaatagttcttcaaatatttggagacagctctgttctgctaatcttagctttttcagactgagttgtatcaaattctctaagtattattggtagcatttctcaatgacagtagcaattgcttatgttaccacagcactttggagtttccaaaacactttcacaactgtaggttcttaattttataaatgagaaaactggggctcagagaggataagttacattaccttaataattgatttaacaagtactaatggagtgtctactgtatgcttggcgcaggcaaaatcctaggatataggagataatacatcaagaatggtgccccccttctagctcttatgatctagtatgggaggaatacatttttaaaaattacagatgatacccagataatagtcacacctggttgggactttagcccaagtcttctgtctctaaaccaaattaacagaccattaacttcagtacagcagacactgcacttggattcatgaaacccacttaagctagtctttctgcaactagctgtcctggtacaagctcttcttaagatgtaccttcttcattccataactaaatgtgtgaggagtctgtgcatgtgtggttaactcagaggagaactctacactgatttctataaaattgtattctgccattttctttctacctctctaagttgccaaccttcttttgaactcttattttatcatttctcacacattagatcttcctctcagtttctgtccatctgcaagttttatgaaattgtgttcacctatatcactgacaagaaaaaaaaaatgcccacaagtgcttggtgtgaaagaaagagcacacatttgtcattagtcgcagattagatttcctattagctaagtgaccttgggcagataacatcctctcccagagcaactgattactcatctgtgaaatgaggaaatcaggctggagaatttctgagggatttccctgcattaaaagttttataattcaatatgttttaaaatgcgaggctgagttttaaaattctttccttctgagtgtggagagaagaaaatgcagaatatgtctactgatatttactgataggcatcacctcctgcttcactaaaggaaggaaatacatcagcaaacattggtgcaaaattcatacaacaggggccacttaagcagaatagctaccacacctttccttaat

SEQ ID NO: 158 - DNA, 3001 bp, Homo Sapiens
  allele 1501: 99-6012-220 : polymorphic base G or T
  misc_binding 1481..1500: 99-6012-220.mis1,
  misc_binding 1502..1520: 99-6012-220.mis2, complement
  primer_bind 1292..1310: upstream amplification primer
  primer_bind 1758..1776: downstream amplification primer, complement
  misc_binding 1489..1513: 99-6012-220  probe
gaatggctggtttctcagaggggagctttacttactgtaattcataaaggtcacccaggaaagccttcattatggatctagacagttgcaattagccttgaacaaatgtcccatggcccagtctggttgaaatgtcaatgagagcaggatggggttgattcttatagatggtcttccaaaaaagtattcaaaaatagattttttcctcctaaattgaatcatgtttttaaagtgcctgctctttaaaggaaatgaatagggaattgtattaaattaggttgcatttctaattaaaacaactactaaattattgtgcttataattttggattttcgtttacatgattttcttggagtaggagcacacctgcatattgggtggctaattaaagtgctaaaaatgcatacagtcactcagtatatttgccttgtgagactcatcctcaggaccctctgtcataaactgggatagctcaaattactcccaaagttcatattttatgaggctctggattcaactctttttccctccacttcacccatttctcctacctaactaaaaaacttcctctttggttatttaaaatatctttacttactgagtaaaaattttattaatgatatatttaaaataaaagaaaataaatgagatgatgaatggtatccaggacagaagttctctcagtctaaacagctttccatgacagactaaaaacccttacatggaaaaactgcctcaacgacagcaggaaagactttacaatgaaaaagaaacaaataaaaaggactttcttttccttctgtttccttgggttggttgttctttccaaacatgacttccatttactaaaagatggctgtattttttttgagtcaaaatcacgttgaaaaaatgtgcagttgaaaagagtattttgacatatttaacaaaactgcagaattggtaagttcaaaatatattgaaaaggggcaagaatcaatcattagtgcttcttttaaaacacagtgattaaaaatgagttaacagcctgggtgattaaagtgatcaggaaaaaggagttgtggtcatcacagatatcatgaaaggattcaggttcatgtgtctcaactatgtgatatttcatatcagggaaactggtatatgcatttcagctgcaaaaatccccaaagtccaaattaaatgtttgccatttcttgacacacttctcaaagtaagagtgcagtcagaattatttagattgtgacaattgtgttttttaacttcttgcgtagctatggcataattgtatttagtcttgacttgttttcctgagggtccaggttgatttgcatgctcttgaggaaatatacacgtcttctcagttttaataattgactgacagccctgtggtttctcaggacccagtgagctgctgctcccaggtcagtctgcaagggatgctggttcccttgtggtctcatcaaggtgaggaatttcctgattttagagatttctttatcckaattttgaagactttctttcacatttctaggcataaaaaaatgtacagcactctactgcttgtttaacaaatggatagtgatatatctgccaacaaagaccacatggagtatttcattgactatcagagaagtttcctcgaaaggcaccatacttagtgttttatttccatgagtgaaggaaaattagttatttgaagtatttggctgtctttagttgtttctaaagtagtgctgattttatatgcccataatattcatatatacacccaggatatcattttatatatgtcacaattcatgaaatatcttatatttcatcttcaaacttatcctctggccctggaactattctaatcactgctcttgcttctggaatgcttagcttcatgccatagtagagcattttcagaaaactggtaagctcagctaaagctaatatggcatatatggatagaacatttgatgagtaaattccagttctgaaagtctactagtcgctgaaatacttagaataaaaaatgaggattgattttgtatgtgtcatgaaacagtagcatttctaggtcagcattttcccagctgtgttattctttcctgtttgtcaatgctcagtgcatcttagaggtaggaaattattctactgcttgtgaaactagaactagatagcacatagtaataacacagtgtgaatagttattaggacctattatagcacttttcctgtagaacgctctagctgttttcttccataacatgggtcaaattgtgcctctcttaaatgggaagcacacagggagagggttccatcagacagatgtaggctgcatgactatcaagaggtgagaaatggttcaactcagctggccaagacccactcacacccctgagacccagcctagccagagaacagctggctgatcttggcaggagttttagggcagatagttcatcaccacagcaccactaatccattcattttctttctcaatataaggacccttgagaatgttcccatctcccttctgtgcatttttgctggcttccatccctggggaatcagccacattttctcatgtgtcttcagggcatcttaggacataggaaggggaaagaaatgaaattttaccttcaaagatgagaatggaagagagaataaaggaaactgtcctggacctcacaggcaataaacaaacagttaactgaagacttcactctgattcaatccactcttctttttagtgatctgcctatctgtgatgtatctccaggcaaaaactttcatatacagtagtttaaaaatgagctgtttcttcctgcaggtctgactgcacaggcatattgagcgaggcaacttgaacaccaggctgaggccgattttgtgaagcatctttcactctttctcttttctggggatgtgtgacaggttgtgggtgggtgagtgtgtgtgtatgctggacttctttggaagatgtgggacccaagaagtatcactgtgagag

SEQ ID NO: 159 - DNA, 3001 bp, Homo Sapiens
  allele 1501: 8-98-68 : polymorphic base T or C
  misc_binding 1502..1520: 8-98-68.mis1, complement
  misc_binding 1481..1500: 8-98-68.mis2,
  primer_bind 1550..1568: upstream amplification primer, complement
  primer_bind 1135..1154: downstream amplification primer
  misc_binding 1489..1513: 8-98-68  probe
cctttagaaaaaaagtggttttttttttagctctaaataattaaaggttgcctaaactaatgtgtataagtagatttacctgtaaatatgtaagggaagtcccaattattgtacactttcataattcaatgtgaatttcatacaaagcaaagtttcaccattaagaaaataaacattttgttcctatcactgagtgaatatttgtaatttctatttaagccatttctagatttttttttttttttttggtcttttgtgagcttctgagattggtgccattttatcacagtatttctcgtcttgacttctttgcatgaccccaggtttccagtaagtaaggtatccttagaaaaaaaagtattttaagggaaatggatgcatacttcaggcccattttatatgtaactcaatattgtctttttaaaaggccacactaccatggaataaattaaaataaaaaatcagatttcttgtacgcataacccctgcccagttttaaaaatgtgatcccttatttctagaaacctaaaatagatatccctgaataacaattcatttttaattatcagtagatatatatactgacacagagtataaacaacttctgtcactatttatttaaaatgttaaattgtacatttttcataatttctttaagagaatcttctttggtgagtttaaagtgagagtagacaaataacttagtggctaaatgatttaatgtcagatgacttaatgaccagtttttgcccttgatccagccccactctgatattctacctcctgtgtgcttgtcttcattgtccccatattaaaatggtgactgatacggaattctggaaaaatctgatcgattaattaatgtgaatatgcatgttttccttagattctaatatggtctttcttgtgtaagaatgtggatttctaatagccatataactcaatgtttctcagtttgagccctattggcatttggggctggataattccttgtttgggggctgtcctgtacactgcgggatgctcagcagcatccctggcctctacccaccaaatgtctgcagcataccttcctacccgacccagtgtgacaatcaaaattgtctgtagatgttgccaaatgacttttgggtggaaaaattgctctcgttaggaaccacttatgttaattatggaagaatcttttttttctaatgttatttgcatctaaatttgcataactcatttctaataggtactcggatttcattcgtaattcagaaatagaaaaacatacaatggtctttttaacctgtcctagtggtgaatatacatggtttccttcgcatttatatgttctaatggcccagaaaaaataagaatccagacctctctcatgtaattgttaaggatattctgagccaagccagatttcacatgcatttccattccatccatcccagcattcacagtttccacagctacatattccattccctgcaataaaatacatataggtatyatgattatgatcaaaatgtgccaaatttaaacatgctattataaatcacaagtgtccacaatgaaatcatttcattcatccttggtagattttcttattgtgcaatgatgttattattacatcttattaagcagctgcgagacatctaatctttcaaacaattagtggcatttatttggtgccaccctttaccgatcagatagtcaccatcctgtatcactccagctaggcttttaggtgacaattttgttttcccttaaagagcaagttatatctgacttatgaataaatacagaaaaacataaggctctttgacataacatgaggcaggccaagtaatccgtgaagagagtcttacgtagtaaggatgggcagaaagcaaaggtctaacttaatgacgcacaaagagtcatcttttaccttcagctagagctgaggagaagtacacatgtctctgtttcctcgtaacttggctaaacaaatggatttataaccaattatgaggactcaataaattaggatagcagtggctatgacacggctgagccctctttatacctctcccccatacacacatccagttccctaaaagcaaccaacacatcaactagtggtacccagattctgtttaaaagaatatttcattccctataccatgttcaaagtaaaatggttgccaacaaaattcttttctgtgttcaatatacaactgcatacatgtgagtttgagggtggggaggttactttgtggaaggatcccaaataatcacaaaatttagcttcattctcttgtattcttctatgcctaggaataatgtgaggcttttgtgagggctttttcccaaatgcccacttcgcctttggtagatatttcatattcacggttggccctgttggtccagccacctaaagcattgcatgacgagtgtctcttggctctataacaaactgtggcatagagcaattagaaaaggttaatactgcacctgtacaaatgagaccatcatgtttgtcgcagtctctgtcatcacagtcacagaactccccagaaatataccactcctcagcagaacaaatgcacttcccacaatgacaagaacctgaaattacaaaggctattactcaccatcaccttataactaaaggtttccatctcgaatagaatatcgttgacacactgacaacaggcttctaataacccatcatccaaaggtaaaagtgtattgaatggctggtttctcagaggggagctttacttactgtaattcataaaggtcacccaggaaagccttcattatggatctagacagttgcaattagccttgaacaaatgtcccatggcccagtctggttgaaatgtcaatgagagcaggatggggttgattcttatagatggtcttccaaaaaagtattcaaaaatagattttttcctcctaaattgaatcatgtttttaaagtgcctgctctttaaaggaaatgaatagggaattgtattaaatt

SEQ ID NO: 160 - DNA, 3001 bp, Homo Sapiens
  allele 1501: 8-97-98 : polymorphic base G or A
  misc_binding 1502..1521: 8-97-98.mis1,  complement
  misc_binding 1482..1500: 8-97-98.mis2
  primer_bind 1581..1598: upstream amplification primer, complement
  primer_bind 1249..1268: downstream amplification primer
  misc_binding 1489..1513: 8-97-98  probe
tcgttaggaaccacttatgttaattatggaagaatcttttttttctaatgttatttgcatctaaatttgcataactcatttctaataggtactcggatttcattcgtaattcagaaatagaaaaacatacaatggtctttttaacctgtcctagtggtgaatatacatggtttccttcgcatttatatgttctaatggcccagaaaaaataagaatccagacctctctcatgtaattgttaaggatattctgagccaagccagatttcacatgcatttccattccatccatcccagcattcacagtttccacagctacatattccattccctgcaataaaatacatataggtatcatgattatgatcaaaatgtgccaaatttaaacatgctattataaatcacaagtgtccacaatgaaatcatttcattcatccttggtagattttcttattgtgcaatgatgttattattacatcttattaagcagctgcgagacatctaatctttcaaacaattagtggcatttatttggtgccaccctttaccgatcagatagtcaccatcctgtatcactccagctaggcttttaggtgacaattttgttttcccttaaagagcaagttatatctgacttatgaataaatacagaaaaacataaggctctttgacataacatgaggcaggccaagtaatccgtgaagagagtcttacgtagtaaggatgggcagaaagcaaaggtctaacttaatgacgcacaaagagtcatcttttaccttcagctagagctgaggagaagtacacatgtctctgtttcctcgtaacttggctaaacaaatggatttataaccaattatgaggactcaataaattaggatagcagtggctatgacacggctgagccctctttatacctctcccccatacacacatccagttccctaaaagcaaccaacacatcaactagtggtacccagattctgtttaaaagaatatttcattccctataccatgttcaaagtaaaatggttgccaacaaaattcttttctgtgttcaatatacaactgcatacatgtgagtttgagggtggggaggttactttgtggaaggatcccaaataatcacaaaatttagcttcattctcttgtattcttctatgcctaggaataatgtgaggcttttgtgagggctttttcccaaatgcccacttcgcctttggtagatatttcatattcacggttggccctgttggtccagccacctaaagcattgcatgacgagtgtctcttggctctataacaaactgtggcatagagcaattagaaaaggttaatactgcacctgtacaaatgagaccatcatgtttgtcgcagtctctgtcatcacagtcacagaactccccagaaatataccactcctcagcagaacaaatgcacttcccacaatgacaagaacctgaaattacaaaggctattactcaccatcaccttataactaaagrtttccatctcgaatagaatatcgttgacacactgacaacaggcttctaataacccatcatccaaaggtaaaagtgtattgaatggctggtttctcagaggggagctttacttactgtaattcataaaggtcacccaggaaagccttcattatggatctagacagttgcaattagccttgaacaaatgtcccatggcccagtctggttgaaatgtcaatgagagcaggatggggttgattcttatagatggtcttccaaaaaagtattcaaaaatagattttttcctcctaaattgaatcatgtttttaaagtgcctgctctttaaaggaaatgaatagggaattgtattaaattaggttgcatttctaattaaaacaactactaaattattgtgcttataattttggattttcgtttacatgattttcttggagtaggagcacacctgcatattgggtggctaattaaagtgctaaaaatgcatacagtcactcagtatatttgccttgtgagactcatcctcaggaccctctgtcataaactgggatagctcaaattactcccaaagttcatattttatgaggctctggattcaactctttttccctccacttcacccatttctcctacctaactaaaaaacttcctctttggttatttaaaatatctttacttactgagtaaaaattttattaatgatatatttaaaataaaagaaaataaatgagatgatgaatggtatccaggacagaagttctctcagtctaaacagctttccatgacagactaaaaacccttacatggaaaaactgcctcaacgacagcaggaaagactttacaatgaaaaagaaacaaataaaaaggactttcttttccttctgtttccttgggttggttgttctttccaaacatgacttccatttactaaaagatggctgtattttttttgagtcaaaatcacgttgaaaaaatgtgcagttgaaaagagtattttgacatatttaacaaaactgcagaattggtaagttcaaaatatattgaaaaggggcaagaatcaatcattagtgcttcttttaaaacacagtgattaaaaatgagttaacagcctgggtgattaaagtgatcaggaaaaaggagttgtggtcatcacagatatcatgaaaggattcaggttcatgtgtctcaactatgtgatatttcatatcagggaaactggtatatgcatttcagctgcaaaaatccccaaagtccaaattaaatgtttgccatttcttgacacacttctcaaagtaagagtgcagtcagaattatttagattgtgacaattgtgttttttaacttcttgcgtagctatggcataattgtatttagtcttgacttgttttcctgagggtccaggttgatttgcatgctcttgaggaaatatacacgtcttctcagttttaataattgactgacagccctgtggtttctcaggacccagtgagctgctgctcccag

SEQ ID NO: 161 - DNA, 3001 bp, Homo Sapiens
  allele 1501: 8-95-43 : polymorphic base T or C
  misc_binding 1502..1520: 8-95-43.mis1, complement
  misc_binding 1481..1500: 8-95-43.mis2,
  primer_bind 1526..1543: upstream amplification primer, complement
  primer_bind 1125..1144: downstream amplification primer
  misc_binding 1489..1513: 8-95-43  probe
gaaacaatctcttagggtggctgccatgacaatggcataagataaactgcccagcacagcagatgttttacgaatttatgcctggtgttccattattgggacgctaagcatgtgggagttttttatatcctactgctccaggtcatcaccaaggtctgactgcaaaaattcaaaaaagtctaacctcagtcataaacaggttaaaagggcttttcccctcaactcacagagaaaggaaagaagaaagtatttttttgtcaggtttcaaatgtcttatcgttggttagagagagaacaggcatatagatgattgatatagatagataatagatacacagataatagatgatagatagatagatagatagatagatagatagatagatagatagacagacagacagataggatggatggatggtgcctcagccttccattaagacacacactctactacccattagttatttttcctgatcctctccctcaacccaccctccaccctccaataagacatatgtaacaagcctacctatgcatccctgaacttaaaataaaagttagaaaagacacacattctgtttctttcccccaataaagggatataattattttcttgtaatgtaattccatgtccacatcacttcatttatactggaaacgtggaaagatctgtaattcacatgcatcagcctcagcgatatgaactttttcaagaatgcaatgcaagaataatgttgacccacattcccagccatggaggtgctcggatcagcactctactcctgggactctcatttttgtgggttacctctgctcactaccttctatctgcctcactcattctctggacagtttattaatgccagtgagctcttgtttgggtatgagaggcatcatagaatctgagcgtatacctcttgtgatttctaagagtaatcttactccattttttcaagtttgtgggtgatattatactttctcctaccagtgtttataaataaagtaatgaaaatcatgttaaaatgctgacttgccccaaaacctttcacgatcataaagtatcttagtacttagattcaatgatcttttattgatagtgtactgcgtactttcacatacctgctaaataaagagttcagggaaataaaagtcattacaaacctaattgtatattgcttttaggttcaatggtatattgctttctgtttatcttatttttaacagcaattgaaaaagcaagagtcagtagaataacaaaggcaggtaaagcaagttgcatgcaggtagcatacagctatgagaaaggttactacctccacagaccacaccatcgaggtcttcacagcggcgatcatcacactcacaagtcttgccatacacccggcgatctcctggaggatagcaggtgcatttgccacattcacatttacctggaaagtataaagaaagtgcacacttatgaggagagtcccggaatcactaaggctttcaaggaggygagcacactattaaacccaaatctcctagaatagttccagtctgtgcctgataatagttacacaaatacacatttccaacctccctaaggtaagctgaagttcaagaagaaattccgtggtggtctggagtggaagtggcagttgctgtctcagaagtcattcacatttgctattctctaatttttgtttcattcatttttgaataaatccattataaaactctctggctatttcatatacaacttatcctgatgattccttgaacataacataatacattatatatactgacataatttagtatgatgtggccattttaaaatgttttaatcttgggtctatctgctccatgagaaaaaaaaagtggtcataggtaatatttcaatgtgctattttagtgactatttgtagtcaattttatagttcatagaactcattttagcatagaacctatgtcaaagagcataacctaaatatctttattatcctcgtcttaaaatttaaaattataaatatttttgcaatgaatttggttcatcgtttgggaaccccttaactagtcccattatgctgactttcatcatgatttattgagtggtaactatgtgtcaaacactatcattccctgcatgacatcatttcattttccaacaccacacattgactagaatcattacaatcattttactaaacaggaagccgagacatattgaggccaagtaactttccaatggtgaaccagctaggaagaaatagattcaaaatttacatccattctcattaacctcaaagtttgcacaactaaccattaaaccacattgtatcttaatgtacatctaatgcagcaccggaaggctatatgagaaagtaaatttcttttgtttgaggaatcactactggtttgccagaaatttgcttgggtgacagtgctccgagacatctgttactccctgtcattagcccaaccatcataattacacacccactgaaataatcacaagatgcttcagggctgaccttgcaatgttgttagtcactctgttgctgaacttgtatcttgttaaagaaattctgagttggtggatgatgggggaaagaaaaattagtatttaggatcatataatttcagagctgtaattaaagataatctaatgcaatgattcataatattttctagctgacatgatggggtcacgatccctttgagaatctggtgaaagacatggcaatacagtgttgtgctggctgaccttcaactaatctctacttggaggtagtcccaggttcagcaggaggcaggggtccctccttcaacgatattccctcttcctataccctggcagctagaacaggcacacatcagacacccttggtcagggcttttattcttgagggtgaaagcaaaggcacaacgtctgtgggcagtgtggcaaatgcaacagcatagcaattctgggagccttgaagctcagcctgcagtggctgacattcagaagtga

SEQ ID NO: 162 - DNA, 3001 bp, Homo Sapiens
  allele 1501: 8-94-252 : polymorphic base A or G
  misc_binding 1482..1500: 8-94-252.mis1
  misc_binding 1502..1521: 8-94-252.mis2,  complement
  primer_bind 1250..1267: upstream amplification primer
  primer_bind 1651..1669: downstream amplification primer, complement
  misc_binding 1489..1513: 8-94-252  probe
atgtccatgaactcatcattttttatggctgcatagtattccatggtgtatatgtgccacatttgcttaatccagtctatcattgttggacgatacaacttcactacatagaaaatcaaggtcaatgcttcatgcttttgtctgctaatttaattagtaataggagtgagggattggaatgtgctttcaggatacgcattagttccttttgctaccttagcaagtaatttaatagaaaccttatgtacatttgcactttcaagtatgtgtgctgatgaaaactcacgtgatgcattgatactaaaggccacattctacccccttgaacatagggaatgcatatggtagttcatcttaactaaatctaagggctcttcgtaaaataccttaaactttcaaaaacctaaaaagcagtttgggcagctctaatgcacttgtatttctgacggcagatgactttaatccctagttttccccaaccatcagtcactcttatatgtcctttctcaggacttccagaaatcattttctaaaaagccacgtgaactactatgattatgccaccagacactatttagataaatcctcagagtttattcaggtagtttcagttgctgtcttgccattctgttttctgcccctgtatcatgtcaattattagatttttaataacatagcagaaaatgagttgccttctgctgcccaagggtctttttccatgattgtaggaaatgaacattgaaatgataatctcctgaaggctctggcttatgggaagagagttatttgttattattttgtgtagctttgaagttgacactagtatgactatgttgcttttgaaccacatgaaagaaagtaatttaatgttctaggatgtaaataccgcagctcacaaagattgattgaagtgaatgagaagttcatgtgttgatattaatgtgcagtggaagggatgtctgagttttctttttttgagaattaagttaaatgcctgtcattctcctatagtgtgtgtgtgtgtgtgtgtgttttacatcatggacccacaaagaggccatagctcccatttaaacctgctgtcctagacaaaaatccatgcacactcatatacatattttaggtatacagaccagagaatgtgaagggagtaatgtcctctgtgggctggaaatgattgctttacaacaggaattctgtctcaatggaattgctttacttcagggaaaacagaaatgggcaaactgcagtggtctatgcaggtatggatggaccattctcacacctaaccaagcaatgtttgcttttcctcctcctttcttcccatcactagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcrtcctgagcacagttgagtgatttatcctcaccagacattcctgctccgtggctgaagagcagcaggaagtaagctaatgcttattctttgctgtctccgaacttctctgttgcaagtggataaatctcaacctgttgcaccccccacaacaagaagacacctggataaccagctaaactcagaccatggaatgccctaccagatatggaatgcctttttaatatcttttctgtgactgtgacacttcatgtgaatgacatacttcacaagtacactcgataccttgcctgctgacagctacccataatcctttttgagtcctgtttcagcgaaatctatgtgtttaagttcaattttgtagcacacaaataatattgagtaatttctagttagacgctgtaaacctgtgctattacggatttctcttcttcccatttttacagggctgctcgctccactgtctgtgaccttttgcagggattttgttcctctaaatcttaaatgttgcagttggcttaggtcggagagcaatcagggaatcaggaagccttctaaacctattattacaaattgcatctataaagaaagattaagaaagattgttgtctctggctcacactatcgattaaacacacatatacgctctgtccagtagcagatactgtgctcccaaggtcggcattgcctgggtgggaaatggctcaaacacaatccagggaagctctctatgatatgtgtttgacatccccctctagtttctttgtgtgtgtgtgttttatacatatcacaagcttactggtaatggtaacatttgccttgcccagcgagcaagacccactggtttttgagaaagtgggtccaaagatttctgtaggccttgtaggcctgattaaggttcatttttcatctattaattctcattatttggaaaaaaaaaaaaggaaaatcagtaattataacctacaagaattgcgctacctaaatccatttcagatatactccgtcctgtttttaatgaaccaaacttaacgccatccccgtttctggctgcgttcccctcatactcagcagagcatgggcaagacggctgttgtgttctttcctgcagcagcaatgcaaacgttagttataaattaattagactttaatatttttggtgtttaatgacaagtttttaaactggacatattaggaaaaatattttttttagctcagcatgctgagtccggtactgtgtatttcaccagtacatgcctctagctcagcatctggggctcatgttgcccagtggctgggttagaggtgccttgccatgatctcagaatacagtctgttgaattatcctagatgaaaataaaggcaaaccaacacattcatccatgaggattttggtccattccatttattttcttttattttgcattcttaatttcctttttagtttaacactgtttgtttgagcttagggaagacaactaccaagaaaggccaggaacagtt

SEQ ID NO: 163 - DNA, 3001 bp, Homo Sapiens
  allele 1501: 99-15231-219 : polymorphic base T or G
  misc_binding 1502..1520: 99-15231-219.mis1, complement
  misc_binding 1481..1500: 99-15231-219.mis2,
  primer_bind 1701..1719: upstream amplification primer, complement
  primer_bind 1189..1209: downstream amplification primer
  misc_binding 1489..1513: 99-15231-219  probe
gaatatggagtagggtttcaaagtgttgacagttgagtctgcaaactaaggctgagttatattttagttttttttttttttcctggttttcactaagtctaattccaatgtctactggcagagattgtgtttgcatttgaggtagtggagggcggtactttccaagtgctgttggaatccagataaactcaaggagcccagaaagacaacgggtatagtggctctcctcttatgacttagcactttagttgacttttttgaaaaagtctctgggtggaatacctcagtgatgatttgccaaacaagcagcgttagtgccaacaccttctctaaacttgctgcatcccttccaattgacattaatcccactgcaacttcctaaaaacaggaatgagccaatgagatttgcttattttctctcacccattacaagtaagtttgttcttgccctgcttgttttttagagggagtttctatcatagagttgaaaatcacatttaagaaggaaagagtttatgtctttacatgtaactattttattttttccaatctaaattcaatcacttcttaatagatatattggtgtttgcattgctggcatcaaaaccacacatacacacacaaacacacacatacacacaaacatagtggacagaaataagtaaaaatatttctgttttcaaagaaaaagcattccttggagtttaggtaccattaacttctactataatacagttccggtactatggtttctaactaaatgaacactagaacagagctgactatattttcatctttgtccaaaattttagatgaatcacattttgaactttttatggtatgataatttctccaatatctaaattctttttctgagaaaacaaatgccgaggacatttttgacactcttcttacatgagactatgaaaaagagcagcacttttgttgtagttgttgttgttaataaaaaggataataacatacagaggattataagaaaaataagacatacctgaggttttgtgatgagctatagagaatcaagggcagttccagtggagctgaggctgacaaagtactgcccagctgccagccaaatccacccttaagttgcttttgtatggcctgggagctcagaaggaattttttaaattttttttacagctttaaagtattaaacagaaaccaacaaaagaatatgagacagggacgtacgtggtccgtaaagtttaactttctgatccttaataggaggataagcgccgtgatagagaaatccaaaggtcatttgtattacgatggctagataatgtaatgaattccaatgtctgtgcatcagcgaatacgtcatcaaaattgctacaaaacaataataataggttgttcacagcttaaaatgtttaggtagtgaagaggaaagaatataacctacattatttattgactacttatatttccctcattttacggaagagatctatcaatttacgtactcaataakagaactacaacatggttgcactccttaatctcaggatagagataacaatttttataaatctattacattatgagaacattgttagtactataaaaatcagcatcagttaaatgttctcttaaaataattttcaatattaaatttttaagtaactcagtggatgcatattttccttatttttggaaatttgacttataaagtttaagccatgactagaatatttacatcattaaaataaaatttccaagtaaaaattttcatcttaaagtaatacggaaatgattttgctacattattctaggattttacaaagtaattcacctttagaaaaaaagtggttttttttttagctctaaataattaaaggttgcctaaactaatgtgtataagtagatttacctgtaaatatgtaagggaagtcccaattattgtacactttcataattcaatgtgaatttcatacaaagcaaagtttcaccattaagaaaataaacattttgttcctatcactgagtgaatatttgtaatttctatttaagccatttctagatttttttttttttttttggtcttttgtgagcttctgagattggtgccattttatcacagtatttctcgtcttgacttctttgcatgaccccaggtttccagtaagtaaggtatccttagaaaaaaaagtattttaagggaaatggatgcatacttcaggcccattttatatgtaactcaatattgtctttttaaaaggccacactaccatggaataaattaaaataaaaaatcagatttcttgtacgcataacccctgcccagttttaaaaatgtgatcccttatttctagaaacctaaaatagatatccctgaataacaattcatttttaattatcagtagatatatatactgacacagagtataaacaacttctgtcactatttatttaaaatgttaaattgtacatttttcataatttctttaagagaatcttctttggtgagtttaaagtgagagtagacaaataacttagtggctaaatgatttaatgtcagatgacttaatgaccagtttttgcccttgatccagccccactctgatattctacctcctgtgtgcttgtcttcattgtccccatattaaaatggtgactgatacggaattctggaaaaatctgatcgattaattaatgtgaatatgcatgttttccttagattctaatatggtctttcttgtgtaagaatgtggatttctaatagccatataactcaatgtttctcagtttgagccctattggcatttggggctggataattccttgtttgggggctgtcctgtacactgcgggatgctcagcagcatccctggcctctacccaccaaatgtctgcagcataccttcctacccgacccagtgtgacaatcaaaattgtctgtagatgttgccaaatgacttttgggtggaaaaattgctctcgttaggaaccacttatgttaattatggaagaa

SEQ ID NO: 164 - DNA, 3001 bp, Homo Sapiens
  allele 1501: 99-15239-377 : polymorphic base G or C
  misc_binding 1482..1500: 99-15239-377.mis1
  misc_binding 1502..1521: 99-15239-377.mis2,  complement
  primer_bind 1139..1156: upstream amplification primer
  primer_bind 1579..1599: downstream amplification primer, complement
  misc_binding 1489..1513: 99-15239-377  probe
  misc_feature 1878,2817: n=a, g, c or t
tccatttagtatctggtatattttgttgtcctaatttcttgataaaagtattaattctatttcattcagcaataactttgcatacaaggatatttttgcatgaatcctctcacacgcatttcattttcttagatccaaaacttcatttggttaatcttcaagcttcaagttggggacagcagaggacatagtggtttgctttcatgcaaagttcagtctgggaaagacagttgctacatgctgttctacaaatcatgtgtcagaacaggaatggagtccaggcaccagcagagatactcacccttccccgagcacaatatgccatctgctgattcacacagattcttgctttgttcttccgtcatgttacacttccgcggatgttggcagagctttccaaaccatcctctctcacaaacacagcgaccacaggaacatgtgccgtggcctgtgaagcaaccacaggaaaggagtgagaggatgaggaaataaccagctgaagcagagagttttaagaaagaaatgtgtaaaccataggatctcatttcccatccaacacattcttctttatgcatagtcaatttggcatgtaattgtttgaaagaacttacaacagagttctagcttaacataataaatttgaatgtagcataggagatgacttgagagaaagaaatcttgcaataattttaaatggaattataccacctttcttgatagaaaatacttcttcatttgcatttttatcagtatggagtcttagcgctattcttcattgcacacaccatgccatccagaccaatttgcaaggctagtcacattaccactggtggcagtatttattgattgttctcctattgcttactaataaaacaaaagggtaactttcatacaaatggcatttggcactatattagtttatctgtatacctctctgcttacaaataacaacagatacaagtggaagtaatggtgtctctctattattgcataaaaattaacattagcttggattcatgtttggcacattttttttggtttggttcctgacattggttcctggtttttcagatgtttatcttttggtatatatgtaacattgtatttgtgacagctatataccaggatgtacacctgtttattgcctgccaccaacacaccattagattgcatgatattccatttcaatttcttccatttcagtttccgctcgaccctttattccttttcctgatatgtgcattaccttacagcagggtctctctgaatcaactatttgcctagcgaagagttactgagtatctgttatcaacagagcattttgctacaaaatcaagcaccatggacaaagtggtccctgctcttctcccagggacagatacgctcatcattcacactgattagcctctctgaagctgttgacaccgttctctcctgaccatttgctctggcaggaccctcaggagtgaaccttggtccatctgctccccctccattcagstctccacagggaggatgagtaaccaatgcttaatggtttgcaattaattattataattattttttcttttttttttaggagtgataggaatttctttaatttctacagaaatccctctaacagtttagtggagaatgaaatagatggctgtgagaattgagagcatgaacgtgtgcagactggtggagaagcccaagttttggcatgagaaatacagtgaaaaatgcagtagagtaaatggagtgaaggacacttgcgagaatgcggatcggtaggacgtggtaagtaactgtggtgaaaaggtttttgatcactgagaggtaagcagaagtctcctggagagggtttcttggaaaactatttttttttgttgttgntgtttttttttttttttttgctttttaaattaaataagagagattttccctgggttataccacatccctacctcacaggccatgcaacaagtgcctcctaacagccagagaaggtctgggagagcggttttttaatccagcatatgttgctcccctggagaaaattgggatcctgaaagaaagacaggatactaggaatgtctgacattcttttaaaaaatattctgggaaaaacatcggatacgaatgggggactactaaatctgcaagaaaaatgtcgctgccatacctttaacatgcactcaatcagcaagtgctctggcactttctaaggctaatgactgttcttgtcacacaggttagcaaaaaaggaaaaaagtaaataaataaacaaataaatgaggtaattgtggtctttttcacctagcttgatttacatgcaaagtaaaaacaaacaaagaaacaaacaaaaaacccaaaaactgaaaccattaaagtttaaaagtagcatgcatgtaaacatgtgaccgataattggctcagccagatcggaactgactctagttcctctgattccaatgtctacactcttcccaatgtgttgctttgcttctatatttcactttagaaagtgagacacagcaggatttcttaattcttgtctctttcaaccaccacatcatttgaaggtatatatttgatattcacaggcactttctctccttgcaagtctcttctctattggcatgccacaaaattctcttggcctcattcaacactcctcctttgtctctatttattcttctacttttttttttttttttttttttttactgaatgaataagtgcaggtattcacccaatgtttatctttaatcatcttttttaatctctccataatttctttcttgaaaaatccattaaattttgggctttcanataactgccaagaccacagggctctatctccagcccctgattttctcctacattcccctttcatgattccacactttgtgttctattagcatccccacttaatacctccagagctacataggcagggtccgacccatagaccctggtggaacaacggatgaacaaatgcacccagacacaggta

SEQ ID NO: 165 - DNA, 3001 bp, Homo Sapiens
  allele 1501: 99-26126-498 : polymorphic base A or G
  misc_binding 1482..1500: 99-26126-498.mis1
  misc_binding 1502..1521: 99-26126-498.mis2,  complement
  primer_bind 1004..1022: upstream amplification primer
  primer_bind 1525..1545: downstream amplification primer, complement
  misc_binding 1489..1513: 99-26126-498  probe
gttccatctaaggatactttgttaccctatgttgtatgaaaaagtggattttctctttagttgctagtactgtattctgtgcggaaaagaccattggagtcacccctattttttgcaggctcaggggttggtattagatgaagaaacacaagatttctctgtcagttgggaaatcctttttcctcttaggagtttattaggttttttagctgccactaagtttagcttataagaagagagggaaacagcctctgaaacttccaggctgatcctttcatttatctaaattccatttctacctctgcagaaaagggctagataacaaatctgatcctcttttctctacagtaatagctcccacccaaagactattataaggctaaataggacaggatcttaaggactgagaagtgccatagagagcattgcctcctccctcttaattttacagctgagcaaactgaagcccaaaagattaagttattttcccaggagtcacatcagtaagaaggtcatatgtaaaattaaaataggtgagacagttattcattgaatgatgtgaacctgtctttccaacctagggatcagatgttaagaatcgtaacaatgggtcggaagggtaatgggcactcagagaatctgtatgaatcccaggcaaccaagctactatgggagagaagagaaatagcccagccagatacagtctgcatgggctgcaccactggccccacctccgctaactgcttattgcccactgatgcattatgatctttagccatcctgatcactcttggattcatcactgcattctctactccatcccaggttccctaatacatgtacatatatatgtgcctcaccccctcaagattcagactcccagttgagagcatctcattggccacatgacatcatctacggttccctaattgctggggttagtggaaggggacagaaaagttagggataggctcttacctctcacctgtcttgtgactctacccaaatcaacgtgtgtttggatgcagaattgtcaaaatgacaatactcacgataactctgtgcagtagtagctctgttctgcacttgactcagaaagcagtcatagtcagagctctggcatgctctaaaccaagatttggttggaaatttgatctctcatggaaaaggtgcttttgttattgttgttttctcatggaagaagcaaccaaacatctgttgaatctttaagtcagattgtctcaaagcatgttggaaacaacacctacatcagaatcatctagggtgcttattagagcagatacctcatccctcaacccagaactgctgatttgaaattcatggggcccagatacaaatgcacactgaattgtgaggactgctgatctatactcagtcactacatatgttcctgtaggatgttacatcctttcatggactttttcgatttgttgccaaccacatagagaactagaaagttaggtcaagaaataagagaaartattaggtttagatttctgggtgccaagcaagccctgcaattatttagttattgtgtctttatggttactgtatctttattgttactaggtccacatagttaccatgttatgctctacaagggcagaagagtaaaatatattaagctactagcaagtgctcatcatactcacactgaaggaatttgctagcaaaagccatatttgcattctaacttggtgcagtgatttacaaagtgtggtccctagacaaacagcatcagcatcacctgggaacttgttagaaatgcaaactcgctcctactctgtccccagacttacattttaactagctttctgggtgattctgatgcatgctaaagttagaactgctgctctcagcttccatttccttgtctgaataaaacaatgataattgatccttcatagtttttctttagattattttctgttgtcattataaaactaagataatgtacaaaaaggcacttagttcaaggtaagtgttcaataaatagtaagcatattattgagcttatatttaatttacaaacactgctcttattttctaattgtttaacttcaagagaatccacaggttgcctacaatataagcagtcatgttagatgttttatatatataagttctaaatgggatgcagaagttctaaaattgtgatacttaaccaggaaaatggcagatttttattcttccattttagaaattaggaccaggctacttacttttctactgtcatttaaatccactttaaggtattcacaatgactttaacatgacattaataagcttagtgggtctttgaatttcttaatcccagtttcctggggctaaatacaataatctgtatctcttcatctttgacacgctgataaaaatccctgaacctggatttgcatttggttttcaaaatcaatcattttgctattcaaaggcaaggcaattgagtgaggtttgagattgaaatacatatcaaccccactagagggtgacctttatctaaatcagggtgcatataaagtaagggcatcttctgtagccatctcataaaattggattgtataactgtttactcaaggtgaaggagaggctgagaagtgattcttacatgaataattaataactttcaatttctaaataatctattagtcttgtgggaatatttaaaaccaagctattgcaaatttctcagtttgtattttaggataaaattccttattaataaattcagctctgaattttaaaattatctgcttcaattccaattcaaaatatattccccccttttctcccaaaagacacacacaactaaacatatgagaaaatagaaccccaaatttgtttcataaaaacaagcaaacaaaaggctataggactttgttaagttttatatggtgatttagaaataagacaaacatattctctagataccaaaggagaaaaagaaaatccaaatgttcacatagtaattagagagctcagt

SEQ ID NO: 166 - DNA, 3001 bp, Homo Sapiens
  allele 1501: 99-26166-257 : polymorphic base G or A
  misc_binding 1502..1520: 99-26166-257.mis1, complement
  misc_binding 1481..1500: 99-26166-257.mis2,
  primer_bind 1739..1757: upstream amplification primer, complement
  primer_bind 1237..1257: downstream amplification primer
  misc_binding 1489..1513: 99-26166-257  probe
taaaagtcagcattatactctagtgtcttcctggatgtacccatagaacaggctagaatgtcaaccacaagattccctctgttcattcctataatttattattattattatactttaagttccggggtacatgtgcagaatgtgcagttttgttacataggtatacatgtgccatggtggtttgctgcactcatcaacctgtcatctacattaggtattcctcctaatgctatccctcccctagctccccacctcccaacaggccccagcgtgtgatgtccccctccccatgtccatgtgttctcattgtccaactcccacttatgagtgagaacacgcgatgtttggttttctattcttgtgttagtttgctgagaatgatggtttccagcttcatccatgtccctgcaaaggacatgaactcatccttttttatgtctgcatagtatcccatggcgtatatgtgccacattttctttatccaatctatcattgatggacatttgggtaggttccaagtctttgctgttgtgaatagtgctgcaataaacatacatgtgcgtgtgtctttatagtagaataatttataatcctctgagagaacatgatgcagaaactgctgggacagtaatgttacaaatgatggccaccctgcagaaaagagccttctccagatctgcctccactcctttctgttcaatgcatgggacaatagttttaaaagttatacaggacagcagagttcagacacgtctgttccatcatctcttagactttccttttggagtaagccactaaagagggtgaagcaagattgaagttttcctacaagatttcaagtatttcatgtttgaccaacttttgttttctgcatcccaatgcctttgcattttggaaaattgtaaaagttgcaaaagttgctaaagtttcaagaatatggcactcatgagcaaaggtttcctgttcccatgctactgctgctgaactgacacattttttatcattagaaatgcccttagtgtccaaacactcccataaatgttatcatttttactttctgcatggttgtatagtcaagtgaaactgagatgcatattacactgttaagtactttttgcaactttctatactaacaaatcaggctaacctaaaggtaaaggtacaatgtttgtgtctttgtgagttttgcttttgccctatggtagtagttataatgaattctccagcagaatctccccaggaacattcgtttacaagctaagtctttctatttgttcactttttaaaaaaggaaacagcactttgcaatatccattttttagcaataactggtgtcatcataattgactagcctcacactgctattccttctcttttttaaattttctgcaacattctcattggcatctccagagataggcctgttgattttttttttcttaaaacctgaatataagaaaataccccaaatttcacctgcattttgtctcacacatttccrtcagtattatttaccactatccttactagagcccaaaggtccacaaaaaactgccactcttcatggtgtggtcggtgctggtaaagccctggaggtagacacactgggccttgtgctcccacaaactggctggaaaacttgggcaggtctgttaacacgcagagacctctatgcaatgaacccattgaacaagacaatttgatagatgcctctcagctttcagttcttcttttgcacgctgtgtagagtccctcatgaattagatcttagaacattgagacagtagtgtattcctttgccagagcaattatatgttacattagaaggccacctacattgtggttttaatttgtaggatggatacttaaggtatccatgacttcaacactatgcaatctatgcctgtaacaaaattgcacctgtactccgtacactcatacaaacaagcaaacaaacacaaaaggccctctggagaacaggactgtcctctagatgctgacagtctatgttcagtgcctgtctccctgtctctgccttaccccctttctttagggttggcttagactccatgcttcctgttagctgctcattaaatgcagcctgaaaatagttggttaatcatctttgtatattctatagattctgtatatttgtggcacacagccctccctccttccctatagtcaccctgctctatatttaggcatataaaagctacaattctcctgtattcacagatttgaatatagagacaggaaaaaaaaagcctacccaagtctccactaaaagtctgtttaatgcctcccagtatttatagaactcgattcttccagacacttttatttgttttatcttaacaagtctcattattttcttctagggttcgaatctgtacagaattatttttaaaaattacagcttgtgtacataacagcagtcacactaggtgcaaagttaaaacccatttaaagagaataaagcttcaatgaggaaatatggaaataatgacaagcctaggaaaagaggtctaactaacatgaatgaccacacacacacacacacacacaccacaattagagtctccacaactctgatctgtaacttaaatgaatgtcaaattgcctcacaggaatttcagatcttcagtctgaagttctggtagataatattgaacatattcctcagcaacagcatgcatgcttctaaatagccactagaattcattggaaaagagcaatatacaaacaaacaaaaaaccccagaaaactggcaagctgatctagatggcaacattggatgaactagaaaactgagaccactggatactaaccagtttgagataacagtatcagctggctttctttggaagagagagagaagcactaaataagtgaggttctcaattttaataagttgcattattcaaacatagaactaaagctattagatttttattaaaagtgcctcctttgaaagaaggctagactaatgtgtttctga

SEQ ID NO: 167 - DNA, 3001 bp, Homo Sapiens
  allele 1501: 99-26167-278 : polymorphic base T or C
  misc_binding 1502..1521: 99-26167-278.mis1,  complement
  misc_binding 1482..1500: 99-26167-278.mis2
  primer_bind 1759..1778: upstream amplification primer, complement
  primer_bind 1319..1339: downstream amplification primer
  misc_binding 1489..1513: 99-26167-278  probe
atatgaaatatatttacatcacattttctttgtccattcatccattgatggacattgacccccatattctggcaattgtgaagagtgatacaacaaacatgagagcacagacttttttttcatatacccagcagtgggattgctggatcatatgatagttcccttttttattttttgagaaacctccatactgttttccatagtggctgtactaatttactttcccaccaaaaagcatatgagggttcccctttctctgcatcctccccggcatatgttattttcctcattttgattatagccatgtcaactggggtgagatagtatctcattgtggctttgatttgcatttttctggtgattagtgatgctgaacattttaaaaatataactgttggctatttgtatgtcttctttcaagaatgtctattcagatctttgtccatttttaaatggggtttgttattttgttgttgttgaattgttcaagtttcttatatattctggttattaatcccttgttagatagatagttggcaaatattttctcattctgtaggttgtgtctccattctgttggtggcttcctctgctgtgcaaaagtttgtcagcttgatataatcccatttatctatatttgcttttcttgcttacacttttgaggtcttaaccccaaaattcttgctcagaccaatgtcctgagaaattctttaatgatttcttctggtagttttaaagtttcaggtcttacgtattacatttaaatctttaatacattttcagttgattttttaatatagtgagagatggggatctatggttttgcatatggatatccagtcttcctagcactgcttattaaagaaagtgtccttttccccaagtgttttcttggtgcctttgtcaaaaatgagtttgtgaacaaaaatgtgtggattcatttctgggctctctattctgttccattggtctatgtgtctgtttttatgccagtatcatgcagtgttagttactatggctttgtagtatattttgaagtcaggcagtgtgatgcctctagcttgttcttcatagcaagcatttttatagttacttctaaaggatgatcatcttccttggccagtgacatcatataaattactataaagtgttttttgatgctgagctgttttccatataatccaacctgatggccacataaagctgtaaatgttttaaggaagaaaataccttaaacttcctagtagatttggatcttaacactgtcttttcatagagctgaaattaaaggaggagtttttgtttggttttcacaaacatgtcctgaagcattaacctgaaattttaaaactggtttgaaatattaggttttctatcccctgcaaagctgtactataaaattaaaggaaaccaaaaacaggcatgggaatatgatagttaggtggtgttcctgagtgtggtattttaaagttttgactttcagtttcctcatggcattcayttgaaacctggttcattgagggctagctgcaaaccttccagatcttgtccttctttgcagctccaggtttctctggcctatggttctccaggaccctgcagttttttttttttttttcagaggcctgtgccacatcagttacacacacaaaaaaaggcttttgggtaaagggaaacttcatgtactgagcaagaagcatgaatgtaaaaatatagaacccctagggataaggaattcagtggctacctatgccattcgaaaggagtgtgccaaaatgtgcgctgagtagtgcctttcccagcattttctttttttagaaattaaaagtatggctctgatgccaaagctacaaaccataaatccaattaaagtgaaggacttaaatgtacatttgggagagtcgggggaaagtggaaagaggatctgtttctgaatcacctcgcctctttctcttcctccctcccaccctccaccctgaaaacatgtccacacagtgggattgcttgttaaattaggacactatgactatgtaactatatttgtgaaatagagtcaaattaaaattgaaagaaaacaactgaaatgcaaaaaatatgaaaagaaagttgaatccatgctctagtgcaaatgttcttccagctcaaactacctctaaaatagccctggactgcgtgcaactccacatctcacagtttgctttatgaagtatcaaaacattctcaaacttttgactgcaataggtttccatgtttttaaacttttgctctaataagcaaggtctgtctgttttcttttaacaattttataagaaactgtttccttttctcctctccattccttcactcatgtccacccttcctcacttactaattattcatagtcaagcccctaagaagaaaggggcagcgtttgccatactttactctgtgtgtgtgtgtgtgtgtgtgtgtatgtatgtgtctgtgtgtgtgtttggtcaagattaggcagggagacagggatcctaaactagtgctttttaaatgataatacatttccaccgtttaaataaggtatgctttttttctcaagatttttttcaaagcagcaattcccttcccagttcctgtagcaaatgaccatccaactgcttgaacactttcagcgacagggaatgcattactttgtgggagagttgattcttacacaggatagctaggagtattggacatttcattgtccttttggatgtatttattcatatattaatgatgtatttattgagcacctactatatgacaggctctgttctaggcacctggaatctagcagtgaccaaagggacagcaaccactgcccttatttatgttccatcttggtgtcactctacttatttgtcctaattctgtcttctgaggcaaaactaaatcattccattccctgtttttgtgacagccccacaaattgttgaaaatgacatgtcatcatcttcagattaaacattttcttacacggttttcc

SEQ ID NO: 168 - DNA, 3001 bp, Homo Sapiens
  allele 1501: 99-26169-211 : polymorphic base T or C
  misc_binding 1502..1521: 99-26169-211.mis1,  complement
  misc_binding 1482..1500: 99-26169-211.mis2
  primer_bind 1693..1711: upstream amplification primer, complement
  primer_bind 1262..1282: downstream amplification primer
  misc_binding 1489..1513: 99-26169-211  probe
gagagaaagagtaatgtacaacacagtgctcatctccatatgttttcctttcttccaaaatgttggccccttaactcctggttgccttggaagctctccagtgccatcaaccaattttctttcttttctcttcttgtttttaaaaatatctagctttcacatatggtaggagtgttggtcttatgcttgatagttggttataactagaagtgaaaattttaagtcataattcttagagaaactggctattaggaaatattatttccattttgggtccctacttcttaaatatagaaagactatcaaatatcttgacaaaaatagagaggatgtttttcttatataaagctcatgaccaagtcttcagcaccaaatttgtatgtaaattctttgaattttttggaagaaaaatattgactagctttttatttgatttgatctttcagaacattacccactgagtaaatccatattccactctaagttttaataaaatctgtgacggagatgggtatttctgtcaatactcatttctggggatatgtgtgtgtgtgtgtgtgtgtgtgtgtgtgtgtgttgtatgtttcatgcctttatacaggttgagtatctcttgtgtgaaatgcttaggaccaaaagtgtttcagatttcagatttttaaaatatttttgaatatttgcactattcttactgtttgaagatccctcatctaaaaatagaaaactcaaggtgccatggctcatgcctgtaatcccaatattttgggaggctgaggcaggtggatcacttgaggtcaggagttcaataccagcctggccaacatgatgaaaacttgtctctactaaaaatacaaacattatctggacgtggtggcacacacctgtggtcccagctactaaggaggctgagatgggaggatcacttgaacccgggaggcagagtttgcagtaagccgagactgcaccactgcactccagcctgggcaacagagtaagactctgtctccaaaaaataaaaaataaaataaattaaaaatcctaaaggcttcaatgaacatttactttgagcataaccattgaacatcatgtcagtgttcaagaagtttcagattttggagcattttttatttcagatttttaaattaggaatgctcaacctatgctactaatactactagtatttttgttgtaaaaattgggttattctttcactttccaagtttatttcctggcagcaacaaagttgtagattatcaaaccaccttccagaatgttaaaaacctatgagcttacctgaaaaagtctctaataaagatttgtgtgggatctaattatgacttagctcttaaagttcacaagagaggttggaaacagcatatctcttactccaggctgctataactctgggcaacaggtgtattcttactcataagcaccctgcaaagactggagtagccctgacaagaaatctgagtattcttctctgaagcctgtggttcaytgtgatgctgctgccagctttggccacaccccaaatagacctctatttgcagagctcttccacattagacctgtgtgcttttgaataagtgactcggctgctctaatcttaatatccttatttctcaactaagtttataattctatctattctgcttaactcacaagtaaaacttgaatgagataatgcatgtgagagcatttgtgagttgtcacactctaggcacatatggtgagcggggcaaacccaggacctaggtaaatctttccacatgtctatggatcagaacccttttcttctcctgtacacataataatatatatcctagcataccatgtttctaatttcatttccaggaataatgatataaatcagtttggaaatgtgaattgggagaaaaagatagaagttatttgttacttacttccatctttcttatccttatttgtctctagtatattttcttatgtcttgcctagaagcagtttcaatgattatcagttcagtcatcttattttatagataaagttaccccaaaacatagataaggcccaaaactgtgaaatcccctattatggtctcatggtgagtcattgtcagagcctgatgagaaataactctcctaattggttttattgattactgttgatgcagcattgcatcattgtagataaagcacacacacagatatacatgtctgcctgcgtgcatgtaggtacacatatgccctccaaaaaattgcttatctgaggctgtaggaaaggatctattatatttttcaactcttccttcatccctaagtgacaggaaagaagggatttcctttccactcagattccccgctgttaaaagcattaatgttttctttttggagccttttgctgcctctcattatgtttttctccattgcggagttggagtcacactatgagaaaatctgaatattagaacacaaagtctgcggatatgacccataggcttgctgaggagtgatctaatagccagggagtgatggtaggtgagaggtgaaatgtacagagtggggggcatagaagagggagctatggagttcaggcaaacgcaatgcaaaagccacagcaccttagtgtgagtgccatcatctgaaactgtccttggtggtatgggaagcgttgatttggggcaagaaaaaggcaagatatttatttgatactgacttgatgatatgaacacaaaatgagaaaaatattcaggcactgctattgccccaccttaatagtaaaaagaaagggaagggaggtttctgctagctagcaaactttgcaaatgggtatgaatacccttggagaaccaagcagtacatgggtatgagaacccataggtatatctttgtgcagtatcaattttaattatggttaagtaatttaaaatacttgatatcaaaccaaacaggtatttagtagattataattgttaggatattcaagtagaatacaagattccaaagaaattcctgattac

SEQ ID NO: 169 - DNA, 3001 bp, Homo Sapiens
  allele 1501: 99-26171-71 : polymorphic base A or G
  misc_binding 1481..1500: 99-26171-71.mis1,
  misc_binding 1502..1520: 99-26171-71.mis2, complement
  primer_bind 1431..1450: upstream amplification primer
  primer_bind 1860..1880: downstream amplification primer, complement
  misc_binding 1489..1513: 99-26171-71  probe
tagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctatcacctgttgtttcctgactttttaatgatcgcctttctaactggtgtgagatggtatctcattgtggttttgatttgcatttctctgatggccagtgatgatgagcattttttcacgtgtcttttggctgcataaatgtcttcttttgagaagtgtctgttcatatccttcacccactttatgatggggttgtttgtttttttcttgcaaatttgtctgagttcattgtagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtcctcgcacatgcctatgtcctgaatggtattgcctaggtttacttctagggtttttatggttttaggtctaaagtttaagtctttaatccatcttgaattaatttttgtgtaaggtgtaaggaagggatccagtttcagctttctacttatggctagccagttttcccagcaccctttattaaacagggaatcctttccccatttcttgtttttgtcaggtttgtcaaagatcagatagttgtggatatgtggcattatttctgagggctctgttctgttccattcatctatatctctgttttggtaccagtaccatgctgttttggttactgtagccttgtagtatagtttgaagtcaggtagcatgatgcctccagctttgttcttttgttttaggattgacttagcaatgcgggctcttttttggttccacatgaactttaaagtagttttttccaattctgtgaagaaagtcattggtagcttgatggggatggcattgaatctataaatgaccttgggcagtatggccattttcatgatattgattcttcctacccatgagcatggaatgttcttccatttgtttgtatcctcttttatttcattgagcagtggtttgtagttctctttgaagaggtccaataattggataattattaatgtatttaacaactacctgcatgacactctgtgtctattgagtactatttaatcttcacaacaaacccatgtggtaggtacactacattatccattcattaatacactaaattatccagtaatcgataatacactaatattatccattcattcattttacagatgaggaatcggaaacaaaaataaaaagcttgcatagctttgaagagtggggctgggattaggagaagatctgctaactgtttagcccatctgcctgcctrctatttgcctgcacttacaaggctgaatttggctgaagaaaaatacgcagacacattggtcctactttaaattcacagtcaataacctcagggggccccttggtacatttcttttttaaaatccattttcacttaactggatcatatttcttaccttacttcccttcaaacctcttatgtctcctctcccatttctactctcagctatatccttacttctatttgtctgagaaagtagaaataataagaaataaatgttcacatactccacaactgcttttataagtctatctgcagatctatccatttactcctctttttatttttttactgaacttggggataaactcctagtgctgtaatctaagttcaagacctcatcaaatttagcattagaccatctctcctactcagggaaatcaatccaataattttcttctcttctgcatcatcctactgtgttatcccacatcctcctgtattatccttaacagtatttaaatatgctctaatatttagaacatcttaaataattaccccatgttaaaaaagaatcccctcttggttatgcatttctctctagctattgaattaattgtctgttactggcaaaactctttgaaagagaaattgcaactatccttctcccattctctcttggaccctttctaaacaggtgtttgtccccagtaacaaactgttcttgtcacggtcacccatgacctgcaagtgatcaaactcaagattctgttttcagttcttatcctacccgtatagtatttggcattcaaattttcataataaatttgtattttttactacaaagtggtaaagttagcatcgaaatactttaaacctaccatttacccaaccagtaccctttatgcgatcatctttttatagtgacgatatatttgggtttctaattgagagtattaatacgttaactattccatgtgatttgatgttcagccaaacactaatagtactcagttggtattcgggtaccattagaaggcaatgcttggtgtttccttacttgggaagaatattcctttcatcacatgtatttgtgtttggacagagtggcttgtctctataaaacagaagaagatgaatggtctttctgagaattagtctttgtatttaaatataatagatttgtgattaagcaacggctgcttttcagactccttaattactatcatagcaaataatcattggcaaactaaaatattagtttgcttaatgataaatatcactcaagtttaagcattatgtagaaagaaatagtcataaactttggaagggccgtttatcatagttcattttctctatgtggaacgttttcatggatagatttgttccttatttttacacctaagggtttcaagtattgataatatgttctacctcttctttacctacctattacacagacatgattaaggtaatgtttctacatttgtgtttttagtttttctatgttaattttttgtc

SEQ ID NO: 170 - DNA, 3001 bp, Homo Sapiens
  allele 1501: 99-26183-156 : polymorphic base C or T
  misc_binding 1482..1500: 99-26183-156.mis1
  misc_binding 1502..1521: 99-26183-156.mis2,  complement
  primer_bind 1348..1367: upstream amplification primer
  primer_bind 1798..1818: downstream amplification primer, complement
  misc_binding 1489..1513: 99-26183-156  probe
taatgctcactctacattagttaccaatgaaatctgtcagtgggtatatgttaagcaatataacatgctataaagagcctcttggcagaaatagtaggttaaaatgggagcggaaatttctttgtcaacttcgcagctgtagcgctgggtgtggggcaggactttgtgtttctgagactgcttctttgtacttaggacaaggataagtctcagtcagttgccctgactgggggagttcattggactaatagataattcctgagatgctatctactgctaatattttatgtctatggcctatacaggtggtgtttcttcaattagaagcaccagcaagctaaataaagtatcatgacaataatcacacaaaggtgaatttaaagctttaccttttctctcacctaaccattttcatttttctatcttctcttccatatttgtatatttgtaagttattttaatcataatgtagatacaatccaatcttagcaggagttgttaaatctcaaatgagttaaggtatatgaaatcacctttaaaactctaaagggctattccaaatgcaaaagaagcctgatattattgtcactctttcttaaatatctttccatatctctgcaagataaaaagtgtgaaaaaaaaaaaaagccaggaaaggttgggttgagctgttgtgtttagtgaaagcactttcactaacacagaggacctgccttatgatgcctctgggagtcaaagaaaacacagaccctccccatgagatgctaagaatcttgtcaggtgtattggtttctcactgctgtaacaataagtcattacaaacttaatggcttgaaagaacataaactgattatcttatagttctgtgggctaaaattctgacgtggatctcgccaggctaaaattgacttgtcagtagggctctgatcctttttggaagctgtagaaaagaatccatttctttgccttcttccatttctagaggccatctacattccttatcacgtggcactttccttgaacttcaaggtcaacaatgttgcatttttctgataattacttaatagtcacctctgccttccactctccttttaaggaccctgttattacactggacacacccaaataatccaggataatctcaccatgccacagtccctaacttaatcttgtatgcaaaggcccttttgccatgtcatgtaacacagtcacacacttcaggtataagaatgtaggtgctttcagggagccattgttctctccaccacagcaaagcaatcacatggacacataatcacaatacatcatggttaatgccatagcagcacttggctgcagaatattgtgatggtacaacccaggctgacttcatgcagctcaaggtgcaggagcaggaaaaacctgccagaggcaatcatggacagagaggtgatgacagggtgaataggaactagccatttgaaaagatgcagagactggctttcaatagcaggcagcccaygcagagaacaagcctctattaaaatcctaccatcctgcctcccacattactctcacaattaagtccttgtcactgtccagcctctgagaaaggatctggcatctactgcagggtcatgggtatggcatcttaactgcatgcatcatacccaacatccagtgaccagagtgatagttcacctgtctacgtatgatcttgccactgcctgctttaatctactgacctcaaatattcttaggatgcaattcattttttgtataattaacagacctcccaagatttggacacttggccatcttttccatcctcattccgtggtgatgctactttcttatctaaaataacatttgagattcatacagcatcctgtgctgttatttggccatatatggttatgtccacctttcagagaaattcaagaggctatgacttacattaaaccacatagctaattggcaactgaaccccactgttttcccagcacactatggggagaccagcctactgtcaaatgttagattttgttcctggagattttaggatgaatatgggacaaactacctccttgttctctgcaaattcattttccctttagccatataacactgggtttggggtattttggggacgtggtagtgagtcataacaagcttaattccttttacttcacatgttcaatggcccatgtaattacaaggcccagggatttcctctctgctgttaaaagaattatcaagttaagaatgttttgatcttaattagcttttactaggcctttctgatgcccaaataatatatgtggctaaatggtaaacaataaggatgaggcctatttttttgtttgtttctaaaacacttttcaaagaatgtacagtgggaacctacatggaaatcttcataacaaaaattttttaggtaatataaggcacttttccttaggggaaaattaagagtttagataagggacacatttttaaataatcaaaaaaaattgaaaagatgcttcttttgcatctttggattgtgttgtgttcaattccctattattttattttccttgctatgcaaactctagacatcttgaaaattagctattggtaatcttatcagttctcctgtaagtctgccaagtaattggatagcttttcttgttttttgctatgtcacatcttcgtacctctaacatgcacactctcattctctgtatttatttatagagctctcacctctcaacttctttctctatttctgatattctccatctgaagcatgtatcagaagttctctctgtgattggtggaataaattaaaactgtgtgattatttactactacattcagcagcttggatcaaaaacctagatttacaactttctaactgtgtgaacattgttaaatttctgattgggttaagtttctaattttatatgtatatttatatatgtgtgtgtatacatatgtatatttgtatatgtatgtatgtatatatatagaaatacat

SEQ ID NO: 171 - DNA, 3001 bp, Homo Sapiens
  allele 1501: 99-5912-49 : polymorphic base A or G
  misc_binding 1481..1500: 99-5912-49.mis1,
  misc_binding 1502..1520: 99-5912-49.mis2, complement
  primer_bind 1463..1483: upstream amplification primer
  primer_bind 1946..1963: downstream amplification primer, complement
  misc_binding 1489..1513: 99-5912-49  probe
agtaaaatagagcagaataagagaatggcaagatcagtttgggaaggctctatttcagatgtagcactcaagggacatacaacttaactgaaatgagtgagtgagagagagagagagacaaagacaaagagagagcagggggagcatgctatggcaagacgcttggggagggaaagcatgtggggtggacagcaagtgtaagaaccgtgaggtggccatgagtagcaagcgcgaggatcattaggaagatggacatgtgtggctgatgaggcacgcgcacgaaatagaggcagagttgtcagcagtgggaaggccatgcaggtgcatgggctgtgggaagacactggagctcttagagcaaggagccgtctgcttcggaggaacgttagagttcctaaattcagttaatgaaatgcttgttaaacccctgcattgtgcttctccgtgcccctgatctccccttccccatagcctgtgtatcagtgctgtgtgatgagttctgttctgggtgaactgcacaaagacccttcaaagtttgaagggagtgggaaaaatcagttttaaaggtttaataagggtttcttaaagaaaaataataaagacatgtcaagtgcaccacccctttccccacctgacttcaaacaaagagaaaatcccaccatgtgtcattatacactgtcatttagacaaagacactgaccatgacaagtcaacagtggagatttggacttcatgttgaagaataaaagtagcaaagactttaagttgtagattggcatctttagattgacattggcatagtgacttcattttttaaatgctgccagaatttcttagaaaaaaaagttagagcatatggtgattcacaagtgcctggtggaaaattataaaatcagcagcagtatttctggctgctgagatcctgtgaaccacaactaccttcaaaagatagagggtagcaaaggaagcaagggtgcctttctaactccacacagtttgtagtattttacaacttgtttccctttagcaagtactggcagttctatcaatccaacaagtggggaaccttattaataattatttattttagccatatctcaactttaaatagtaaatattgtaccaccaccagtgtatcctttccagatacccaaactgatgctcagggatattaagtgaattgcccagtgccagtcagttaagaagtagctgaatcaaaatccgaatgtgcgaccatcaggtttcagagtctatgcccttgatactttaccatagaaccacagagaagggaggtttttcaaggcatgatacttgctgaaaataaaaagatacaactttaaatttgtccaagaaaaaattactaaagaaacacatagcccatgcagtttctctaagagattctacatgacattattgtttgctagaaagtagggtgctagttgttgcttttgtaaatataatagtcaaatcatgttaccattaggacacattaaaaatgtcraattaccttgggaccttatatgaacatattaagataataatgatagtgttcagtgcaatattcagatcaatagtttaaacccaaaatatttataccttcagattagatgtatgcaaatgcattgattcatgtgtcttttatctgttgtttacatttggagaaatatttgagaaatatttcaaaatggaatttatataaatttaaacacataatggttttatgtaaaaatattgctaaattacattttccccttaattcttatttcttggaaacgtgccttagtcgctgaaatattcatacattaacacaatgaaagaagtgaaccttactaggctttgactatcaggtttgctgttggtttttgactattgtgaaactatagcctgatttctaaatcaggaagaaacgtgtattgttgttaatatggacacatgacatatttgtctgcctgacttttgatcccagctacaacctctggccttttcaaatgattctttaatatcacataaagggaggtgagataactaaagggggtgattccggactaggaggcaagggagggcagataacatggtgctttgaaatcttctgtgacttttcagtcacttatttcattaagtgatatatctcactagaagtgaggtagaacataacaaatccatgtttgctgggcatatgttatgacaacagagaaattcacagactggtcttacccggcaggggagatggcatgatcatgaaaatggtttttcccagggtgagcttacccattgcattctgatgtgctgatttccgtgatttccccaaatgtgggaaactcactcggctgcataattggtggtagtgggggctgtgttatgctctctccttgatgtcagttttttttttttctaaaagcaaacaaaaacaattggcttcagacattttgaacaaaacaagtagaagctgttttctttaagaaattacaagcagtgtctatctatagatacatacatagtcacacatgctcataaaaacacacaaccacagcaaaattcatgctgtaatctataaacactttttagaaacagggagaggttgtgtgggcctaaagagccaggtggggcagaacctaaaaggaccttgagaatgacaaacatttgaccatgggaagcaggacaggagaaggatgttacagccagtgaccatagcataggtaaaagcaaaacaggtaccaaggagcacactgtacagaccattcagcaaggagcccagcctgactgccaggaagaggctgcctgcaggaatggtgtggaagaccatcagctgcagactgaggcaaggcgatggaggtttaggcttgcttcaataggtgagctacttatacaaggagaaccatgatgaaccatgatggaagtggtgttgcaacattcacatggtgtgggttgtactgggaagagatggacaatagtgtggcttagcgatggcaacgggcatctttagatgagaagaatgtacatg

SEQ ID NO: 172 - DNA, 3001 bp, Homo Sapiens
  allele 1501: 99-7337-204 : polymorphic base A or C
  misc_binding 1482..1500: 99-7337-204.mis1
  misc_binding 1502..1521: 99-7337-204.mis2,  complement
  primer_bind 1298..1318: upstream amplification primer
  primer_bind 1731..1748: downstream amplification primer, complement
  misc_binding 1489..1513: 99-7337-204  probe
  misc_feature 1564: n=a, g, c or t
atctaaaggtatgtgtaattaagttgaaatctattaagaataattaaataacagccttcttcatgataacaacatttgagttgcactttcaaactcaatttctcgttgtaaatataactacagattacaacttaatttctagtccataaattatttttcacctctcttatttgatatttgaaagaaccctttgttgtttaatattatactcaaagtaagaacttggacttggagacctcctcctcctttaagttcaagcctcctctgaggagagatactcctaaggagtccaggatgagggtcattattgagctgttactgggaggggactgaattcgtggatgactctggaaaatagaggttagtaatatattagtagctattatttatcatgtatttattatgtgctatttgctacttgtgtctaatatcgtttctctatttcctctttttaagttattttggaattgcctagtattctaaaaaatgttatgattgtgttcagaatgccccttttatagttttcccttaaatggtgatggtgggcaaacttgaagacattaacaaaaacataattttcatttagtcttagataacaccaaggtgacatagtaactaagtggagttggtgggctaattcctagtggaagcctgggctcgtaacagaacataaaggcttttccaaggatgaaacactggtgaagctcctccttcaagttgtatatgtttgcatatgtgaaaatatgtgcaatccaagtttaacttgggaatgcttagctccttaggaatttgctactgggttaataactcttccctcaattacttaggttggaaagtcctcaaattttaccttagatcaggattggcaaacttttggcaaaggaccatatagtaaacattttaggttttgtgagccataaagatctttctcgaccacgcagctctgaaatttgtagtgtaaatgcagacacagacaatatataaacaaaggaaagtgcctgttttccaatgaaaccttatttacaaaaacaggtgaaaattgtgtttggcctgagagtcagtttgctggaccactggattagattctcaaggtcactttcaattctgaggttatggttttgccagattatctgagttattcattcctgatgagttatggaaggagagctccttccaaccagaagtctctctttgtacaagcaaatggcccatcacggtattttcctaaacaaaggcatttccctcagaagaggaattctgctgctactgttaagataataagtacaccacagatggtgctttcatttcaaaaacaaccacaacataaaaaagatataacatttctgtttaattattgcatttttctatcctatgacttgatgatttagtttggcagtggtgcaaattaatattcaagcttctgctggaactcatctgttgttgattttgttgtggtgggggtgatggttctaaacatagtcaaggaggcaaggtgagaaamagatacatcaaactccttatcgatctcgttttggcagattcaaagagtttatatttaagcctnaaatttaaataagcattttcatattatcactgccagttttagagagtgtttcactggcacaataattgtattatccaactgtatagcaactatcaattagactaggactgccttgagaagcaaagtagggctcctctttctttggttcttgctgctgtacattggaggtctcatactgaaggctcacaggcttccctgtggccccttgacccactcaaggttgaaaaacaaaaactaagaaatagttgccaatgttaaaaggagattatctgtagaaacttacatttcttacttcctttgaaaaatcagatcttctaaagatctaaggtttttattttcacaggagaaccatgtgagggacggctgcttttttaaaaaaatcattgcttctaccactgtcttcatctcctcaccacagagcctgagtcagaggccatttatcctcattacggtgccatgatcatgccagctttcctcactcctgtatctacctggtcattagaggcatttgagtttgtggcccgtgctgtgcacattatccctggagatctcatcaattacaattatttccacctactggactttaagtagttctacctattggacattttcaatgcaatctgttttcctaaagcatactgcaggattgaagcacaaagtatgactgtgcaattactctcaagagcatttttgtttatgttggtcaatgtcagttttttaggtcccttataaggaaataccttttaaaaattcatgccaagaaacttttcattttcaaaaaggaaaatattttctttcttgaataatttttgtaacattatagtctttctctttttgtcctggctaccagaaagttcagaagtcagtgtgtcataatcctgatattatttctccccttactttgtgtgttctggttctctatttgtaatattaatactaactattaacgtgaacacacatatactcatgtgctacaaacaactttcaggttcattttgtgagagattagggttgaaaacatcagtacgacatgttcttaacttttcgaaaccatcctccacactgacaacagatttgtatttataacatacgaatcaggccctattattattcccttgcatattcaggaattcaacatgtcttcctctcacttataagacatctaatttgtttattagagttttcaagaccctttattatgtttctcaaacctatcttcccatctacaacattctccacttctgtcccacaaagcgtgtatctcagtgatgaactatttacagttctccaaatgtaccaggccatttcccacctcttgcctttcacaataccatttattctccctataatcactctagtattttataggtaagtcactcataacaaatattatattgttctgtcatttttcagtgaaatgaatgactattatttatc

SEQ ID NO: 173 - DNA, 3001 bp, Homo Sapiens
  allele 1501: 99-15672-166 : polymorphic base G or A
  misc_binding 1502..1521: 99-15672-166.mis1,  complement
  misc_binding 1482..1500: 99-15672-166.mis2
  primer_bind 1649..1666: upstream amplification primer, complement
  primer_bind 1120..1138: downstream amplification primer
  misc_binding 1489..1513: 99-15672-166  probe
aagactttataactttttttattgattcagtgatcattttcctaatgcttattcatgaagttcatcatcattttctctatgctgattacatcaagggtcatgtaatgtctacttcactaaatgctgcaaacgttgttgggaatcagatgtgcactatcataacagacatgaaatcaatgccaagcatacagtcctgcgttctttttcgttgaaactagtacaatctaccaagaaattttacctctatgataagatgactggttctagccatattagccttgtataaatctttgaatgttttcatttgttcttcataatattctaaaaacattaatgcaatgtgtattcaactttatgagagtgcatttttaatatctttggctggagattcaatagaatctatggatataattgaacatttatggatataattgagctgaaaatctcattaaaacttaaatatgtctttcatactacttgtatgaacctttcattctaatttttactgattaaattttataactgacaagagtataaatatagtctcttcttcatttcaaccacaatatgaacacatcctaagaaatttaaaagaataagctttaaagagtatcaaaggcattcatttaataaatatgagctttccaattctgttttcactcacaaggattttattgatagtaatttttattaataatttcagcgtcaaataattttcatggttacacctcctacctcactcacaaaataatctttgactgtggcatattattaatatttttacttgaactgggataatttgtaagtgttttacattgtttgcagtgaattttaacaacactttattagtcaagagggtcatacaatattggataatctatggaaatatcatttaaaaccaatagctatgatttagaactgtttaaattcaacttatatttggagataattattttacaaaaatattaacatgtttttgataattacattataaaaatttaaaaaagaacttggtaccaggtaaacgaaatccttttttaaatcaaattagtttatattatagaagacaagactatccaaatatgctagtaattctcagtttagctgtcattcaagtcacccttttcaaaatgtgttctaggaaattttgttttggagttatcctagaaatattgacagtctattatttactataaaacaattatgcaaccatttatgtaaagtaatatgagaacttctgtacatgacaagacaacacttaaattgttctcaaaacagcagtgtcacatatgtctctttcaaacacctaagaataatcctctgtttagttagactcatgtagaactaagagaatattcacaccagattttaagatgtgctgctactaactgactataaggagagagcttagagtttacatgttttaaactaggtttagaattttttcctgaggattcaggtaggttgattaaatacagctagactttacctttactcaacrtgtatttgactgcacacacgtgcacatacgcacaggcacagatgtatttttcttttattggattacttaggattaggataataataacactgataataataatcatagcaatcatttgtcatatataatactcttccatgtcctatagaggagttatggtattggttgatgcatgaatattattttcagtgatggcaataatctttcaagatagatagttattattagctccattttaaaaatcaagaatataaagcttaaggagagtatagtatttacctgtatcaaagtactagagatcatgtctgcttagttttaaattccacattttctctattcccatagattttagagaagtatgataaacatattcatagtatgagattttaactagttctcatgggcatgctttctgagttcaatgaggataatttcaatcactcatgtgaatatataaaataataaattattgatcacagacacaaagataaattttgtcatttttctaaaaataaagaaatcactatttacaatctatctttgtgttcaatgctattgtaaaaactaaaaacaaaagcaaaaaaccctctaagacaaaaatattaagacgcatagtacttcatctcttgaaacacaattatgcacactttgaaaatgcccatctaggtaaatttagggtccatggttttaaagtagaaactatactcccattaacacacacacacacacacaccctatgtagagtttgatctcatatccccaaaacaaaagtttttattgactattctaagttcactaaagcatattagaatccctctgctatattattattataataaattatccctcgtttgtatataaatccattatgagaaggtgttgttggtgattaggacacatttgcttttaaaaaaacaagactattagaagttctattatattctctcatgcaaataacattcaaagtttggatgttaaatagaggcatttccaggcacagatcaactcttcgaaaattattgtaggaggcactttaaaggaaaaaaatatgtttggcacaggaaattacatttaactaaaagcattttttaaaatgggcattaacaaattagccgggaatgcatcattcccatcttacgctctcaagcacttaatgcggatagacctacaaatcacattatcatcactttccataccttcatcaaatgtcatagcaacagctgccctagtagctctgagtgtgccttaggctaaaggagacatctgtttgctgacaacttcagatcaaatgacaaatgggagacagaaatgtctgtgcatggtaaggtcagaggccttacctatttgttagtttcagttgtaatagggattttcttcttttgataggcagggaaatgactaacatactatcagttagtgataatactaattcttcttcaatcaaaattaagtagggttacaaaaggaagattattattgttttgtgattgacaggtgtta

SEQ ID NO: 174 - DNA, 3001 bp, Homo Sapiens
  allele 1501: 99-15665-398 : polymorphic base T or C
  misc_binding 1502..1520: 99-15665-398.mis1, complement
  misc_binding 1481..1500: 99-15665-398.mis2,
  primer_bind 1879..1898: upstream amplification primer, complement
  primer_bind 1423..1441: downstream amplification primer
  misc_binding 1489..1513: 99-15665-398  probe
  misc_feature 821: n=a, g, c or t
cagaagcatacaatgtggcagttatttcatatttccatgatagttcaatttttttattgaggcgattctaagaaaaatgtatgagcagtggcaaattaaggagctggaaagaaaataaaaacgtttcttttctgttccacaactggaattaagtttaagctgaattactgagtcttcacaaaggcaaaatttttgactcttaattttgttaatctatttcagcttatttctcaggataaatatatcaactttttgtgctaattagtactttcatagagaaaaagtttaatgattagttattatgcttaccattatttttattttagcaagggtattaatattttttatcacttacagatttttttcttttcaatatgaaagactttgcaaaattattttgacctggaagttcagcgtattattgtttgttcccttattattatccattttactttccttattccattgttgttatttaatttaaaatatttcatacggtatggcaaaccatgaacctggaaatagaaagctgatgcatttaaataaggtgcacttgatatggtagcacccaaatagcctggaggctgtataagcttttctggacagtatgataatcaattcataaattatgtacacctgagcccttttcaccttaggcagtttcaggatgtccaaaaaaacttcaaacttagctctttcaaatcaatggtttaagccatcttaataaccaattagcatcactgcagaaatagtgtaatccattatgaatatttaagtattaacagtttaagaatcttacaagattttatgccaaatgtgtnaacatactctttatctttctagctttaaactcttcctcctttgctgctgtctgtgtgcatttttaccaaaggtagagagaatttattctcttaacgaagagagaaatggaagcttgccctcataacctttgttataacagaatactagaccttgaagaaaagagaaattgtaaagaaacattgaaactgaagcgttggtcaactgtggctcatgagaagaaaaccatgctggtcaaagattttaagaatttttgccattttggctgtaacccccaccccaaaacacacacccaaatcaagagatttccacatgaaatgtatcaccccatgcagtggcataaatgtggtgggtgagaagggaacatctctttttcttgactgtgcatgttttataataaaaatactagattgccaattaattgatcttagctgttgtaaaattactaatccctaagtatcttttattggagaattaattattttctcaatattaagcaatcttcttaagactcttcaagaaattgaaataaacatgaattcatatagagctaattttcaataaaaagtgaaatgattataaaagtgaatagaatctcagaagaaataagggagggtattagaataacccattgatcaaatcaatgaaatttgaaacatgaatgaaacttatacgtgaatgytctctgtgaattacattcattaccttagtaggaagcctgtttcttagtttcatagatagaaagctgacaaaatattttgtttggtttttaattcattcacgattgtcaattgtgcatttactctgtggtgagtctattttttaaccctgttctttgaagtgttagaacaaagatattcctttgtttccacagggaagactttaaatgtttgaaattagtcactatgttttcttctttgaatatggtctttcttccaagttaacaatctaatatgtccagttgttttttatataaaattctatttttatccatcaatctcctgttgacatatcaagcccagtatttcagatatttatacttaacattccaagaagaggctatgcttttcacatttacgtacactcaacttttattaaggcaacatatgcttttctttttagcagcttcttggcactgttggtgattattgagttacagccaagtcaggtctgataaccacaaactactgtctgcagtatttactactttacatttctttttctctctctctctcttttttttaatctaaagcatgccttgagattagtttttatcagattccatgttcttggtattcactcagcattccagtcttttgagataacctgaatctcaattttgtcatcaactattacattgtttacgccttccagtgttgtatcctctcaaatttgaaaagtgacatgtgcagccttgttcataatctgcaccctgtctctccttcacaggtggaaccaattgatccatgtctgtagcatagactactgcctaattctaagagctatctttctcagatagaaaatatttaagcagtttcagcttcactttcaacaaaaatatttatggtatcatgtggatatgatataaaatgtagactgattgttggtattattatgtagattttaatgtgatttaatatctatagctaaattgtaaggtatgtcatttgaaatattggatgaaaaaagatatcatatattttcatatggcattgtagatacttatgcaaatgaaaacattaatttcactacacttctagaaaaaaattaatgtaaagatcaagtactgcatttaaaaaatgaagttgaaatcagaacacaaagaaaccaattctactttacttgcatattatgccgtttaaattttcttacaatttcataaggccgtcagaatcaaagtagctctctaatattcaagtagttaatttgttttagaataccatctttggcaagtataagtcctccctgattttcttacagaagtgaaatagtttacattaatatttgtgcaattttctagagcaaaagaaattgtgagataacctctctgattacacttaaatataaggttcagtggtttcaagaaaatctaagtattttctttcttttctttttttgagacggagtcttgctgtgttgctcaggctggaatgcagtggcgcaatctcggctcaccgcaacc

SEQ ID NO: 175 - DNA, 3001 bp, Homo Sapiens
  allele 1501: 99-15663-298 : polymorphic base G or A
  misc_binding 1502..1521: 99-15663-298.mis1,  complement
  misc_binding 1482..1500: 99-15663-298.mis2
  primer_bind 1781..1798: upstream amplification primer, complement
  primer_bind 1349..1369: downstream amplification primer
  misc_binding 1489..1513: 99-15663-298  probe
ccctgtctctccttcacaggtggaaccaattgatccatgtctgtagcatagactactgcctaattctaagagctatctttctcagatagaaaatatttaagcagtttcagcttcactttcaacaaaaatatttatggtatcatgtggatatgatataaaatgtagactgattgttggtattattatgtagattttaatgtgatttaatatctatagctaaattgtaaggtatgtcatttgaaatattggatgaaaaaagatatcatatattttcatatggcattgtagatacttatgcaaatgaaaacattaatttcactacacttctagaaaaaaattaatgtaaagatcaagtactgcatttaaaaaatgaagttgaaatcagaacacaaagaaaccaattctactttacttgcatattatgccgtttaaattttcttacaatttcataaggccgtcagaatcaaagtagctctctaatattcaagtagttaatttgttttagaataccatctttggcaagtataagtcctccctgattttcttacagaagtgaaatagtttacattaatatttgtgcaattttctagagcaaaagaaattgtgagataacctctctgattacacttaaatataaggttcagtggtttcaagaaaatctaagtattttctttcttttctttttttgagacggagtcttgctgtgttgctcaggctggaatgcagtggcgcaatctcggctcaccgcaacctccgcctcccggattcaagtaattctcttgcctcagccttccgagtagctgagattacaggcgtgcgcctccacgcccggctaattttcatatatttggtagagacggggtttctccctgttggtcaggctggtctcgaactcccaatctcaggtgatccgcctgtctcggcctcccaaagtgctgtgagccacggtgcccggccagtcatttcaatgataggttgggaaagttattttttgttgagcaagtggggatgagagtgcttctttcctttgcttttacatagagggagctcaattagagcaacatccctggcagctttctgctgtgcttcacttatttcttctcatagaggagaaacgacgtgtctcattggtgagtttggagtttgggagaggcacttggactgctcagttaagtctttctcttcttcatttcttccatatctgcctagctacagatcatactcattctctctgtttttccattatgtaaatttaaaggaaagtatctaattcttagggtgggtattgggaaactcaccttctccaacatagactttgtgagtaataaaaaagtctaacttttgtgatcatcgtcatctgtctaacttgtgatgatctctaattgagaaatgaggctgtcatttattaagtgcccaaaactacaatattgtatttgtttgtattatttaggtattcacttattgtttcagaatttttattttattgtggtaagaagagttrctatgagatctaacacatttttaagtggacaacatataattgttggctgtaggtacaatgttacagagcagatcgctacagcttatttattttgcttgactaaaattaatgcctgttgattaataactccctatttctcccttcagtatcaaaaaataaattttagaaagaggctaaatatatgataccaaaagaactatatatgtaaacaaaaaaaaacctatttctataaagtctaatttttaagtgtcctcacctatcaacgtattgaagcaacacgtttagaagaaggtgggaacaagagccagacactggttgcaagtaacgtaatttgcatcttttggaaatgaacaaatattttattcactaattatagtattttctatatatttcccttattttaaactttaacttacacatcatagatccctgcaactgagagccatggctaaaaaatcatctaattcaataccttcttgtacaaagacaagtgtctaacaaagttctaaatgcaaaagttaccctactttgatatctaaaacaggattatgattctatctcaaaaaattggttattttcacctaatatatactcacactgttgtaaaatacataggttgtgtaagaagtattgagatggtattgcagatccctaagactggagaagctttaccaataacaaaatgaataactctgaaagttaaggatggaaattgtaggcaatcttctagtatcccattctagtatttaccaagtaaatgttattcctttttgtctttttgccatattcagttttaagtgtggaaaatttcatacgtatttacttatcctatctttttccagggtccttgcacaaagtaggatttatcataaaaactcagtaaaatgttcttattccagtgttgttccaacttttataattttcaacacacgattctccaaaacatcagactattcttgatgctgtttaatatcttcagattctttggatagcaggagttatattagatccctagaaaacatttatttaatgtcgaatggaatatttttaccctaattttataataataatatttctaatagtcattcataagcacttaaagtaacatttattttcatatttcatgaagtaaggtatagtgcatatcctggaagaaacagattactaaagaatcttgaggcatagtaatgtctgttacaactgacattttacacgatgactatcaaaacattaaactacttaacaactgaccaccaataatattaaaatacatgtttctagcacatttattaagattgttttggattgtatttgtttttgaggtaccaatactagcaaggtaatgttaaagtgtatattttagacatgttaaaactggtcctctgtcatcaaactgctctgtaagcaaaatgcatatatgcaggtgcgtaaaaaaactccaagacattttttttaatttaaaaaaatcaaaacattaggcagactctttttgaaataaaa

SEQ ID NO: 176 - DNA, 3001 bp, Homo Sapiens
  allele 1501: 99-15664-185 : polymorphic base C or A
  misc_binding 1502..1521: 99-15664-185.mis1,  complement
  misc_binding 1482..1500: 99-15664-185.mis2
  primer_bind 1667..1685: upstream amplification primer, complement
  primer_bind 1184..1203: downstream amplification primer
  misc_binding 1489..1513: 99-15664-185  probe
ctaatatatactcacactgttgtaaaatacataggttgtgtaagaagtattgagatggtattgcagatccctaagactggagaagctttaccaataacaaaatgaataactctgaaagttaaggatggaaattgtaggcaatcttctagtatcccattctagtatttaccaagtaaatgttattcctttttgtctttttgccatattcagttttaagtgtggaaaatttcatacgtatttacttatcctatctttttccagggtccttgcacaaagtaggatttatcataaaaactcagtaaaatgttcttattccagtgttgttccaacttttataattttcaacacacgattctccaaaacatcagactattcttgatgctgtttaatatcttcagattctttggatagcaggagttatattagatccctagaaaacatttatttaatgtcgaatggaatatttttaccctaattttataataataatatttctaatagtcattcataagcacttaaagtaacatttattttcatatttcatgaagtaaggtatagtgcatatcctggaagaaacagattactaaagaatcttgaggcatagtaatgtctgttacaactgacattttacacgatgactatcaaaacattaaactacttaacaactgaccaccaataatattaaaatacatgtttctagcacatttattaagattgttttggattgtatttgtttttgaggtaccaatactagcaaggtaatgttaaagtgtatattttagacatgttaaaactggtcctctgtcatcaaactgctctgtaagcaaaatgcatatatgcaggtgcgtaaaaaaactccaagacattttttttaatttaaaaaaatcaaaacattaggcagactctttttgaaataaaaaataaaacaaatatctacttctaggagctatattctgtaggtattctagcaaaacaaatcctcaaatgaaaatacttcaaattaaatagctattaactagaaaaatagtggggtgtacacctaacttttacctcttagaggttaatttctttatcaattgttacctctttcattttgatataagtaaagtaaattatttataaaaagttataatgcatgaaaaggaaaatattgatttcaaatgaaaaataaacagaaaaaaaatcttttacttccacgctttggatacaattttaaagcaggtaagaaatgaagagaagaaatttgggattttattttttggtcataaacaggatagttaatgatttccaccaaggtttcgacttacttgaaaatcaaatgatctgatatccaggtgatctctggaaagcatgtgaacattgtgtttctgtcttttgtttgcactggaatgccaaatctgcaatacaactagttagaaggtttgaccacccgacgaccacacaaagtctaagtggagagtgctgagaggtgattcaccctccttctctgcctggtcagccmgctgaaaccctccagccattaaaccgctcttaacactagggagcacactttccccaggaattatcctggggaagtcagagacaggaggcttcccttgtgcaagtcagcatcaggccccgtgccagcccgtgctccgctgtagagaatgacaagtcacacaaatatgacagtgctaatggtaaacaatgacagttctgtcaggaatctgagaggcttttcatacttctgcatgtgccgaaagagaagcagagctattttatttgtggcatataaaaatgacggcatgaactcttcacccccttttttttcccctttaaacaaatcaaaattagaagagtgttagcagctttatggtttgggaacagaaagcaggaggctttagacatgtgaaaattcttctaaaaatttccctaactaaaaattcgaacatatagtagttttaaaaaaattacttaaatgaccttagatttgtgatatcttaacataaagctttcttgcattctcaagggcatgctaatgtcatctagagggcatggaaccaatagccacacaccagaggctgttagacaggatacaccccatgtaaacatagatgaggcatgctctgacaaggctacagtagaaggaggccacgtgatcattggatcacccgcaatgttacatccatcagattttccactgagttcgttcaaaagtgtgttatatatttacggtgtggaaaacactgcctgaactatttgagacataaaaagaatgaggcaagagctttgctttaaggagctctgggtaaagatgaacacctgcaatgtctgctatacgaaaacacaaagtaccgtacgatcaagagatacagacaaagtacttcgtttgtttggggtgtcatgctaggtattgcggggataagaagacaaagaagatagggacatacactgcagcgaactcagagtctaaggaaagacataagacatgtatagataaaagacacttttattaaaaagaagaaagcacaatacaatcaatgagacacgaagagaaaagaggaagcagtgatactgatatcagtaattatgaagtgcttaaactctgagagcaaccatgtaagctgttgacagaaatgatctcatatctcccaaacaatggactttatagataagaaagttaaagatgagagaggtggctggcaagttatagagtgaagattcaggcacacatttaagcacaaagatgtctttgttaacgaccacataactatttgcttcagtgagctccttttattttgtttgtctaaaatttctttccctttttctggcgaaagcctttgtggggtgtagctctgatggatgtcaattatggtgagacccggtccttctgtatacaagggtggaaacataactcaagcccccaagccactgtaattagactggaaataatgaagggcaaagccaagtcagtaaaatcccttccttgcagcgttttatagtgatgttgagagaaggatca

SEQ ID NO: 177 - DNA, 3001 bp, Homo Sapiens
  allele 1501: 99-15668-139 : polymorphic base C or T
  misc_binding 1482..1500: 99-15668-139.mis1
  misc_binding 1502..1521: 99-15668-139.mis2,  complement
  primer_bind 1363..1380: upstream amplification primer
  primer_bind 1801..1821: downstream amplification primer, complement
  misc_binding 1489..1513: 99-15668-139  probe
ctttaatctgtcctttctcgggtacatcacctagatgcctgatttcatgatggtaatacctcagtgttaagaactggttaaaatttgggtggggtggaggtggaggaaatgcagtctttcacatacaagacttctggacccttctactctgaaattgttctatcataaactcggcattgctgctaaggatgagacatgacaattagatttgttatggttaaaaaaaaagtaaaaaatactgcctattgccttcatgaacaatgtatggaaacctgtagaagttccatgcaaaagattatggcaacccacttttagcatctagtttagaaaagtatgtagtttataagctattgcttccatttatatcctacattaaatgacccttagcacaatatatcaagatttatgcatgtacgtatatattgaaatgataaagttatttttgtacttttcaattaaaattccacattttaataaaattgtatcataactgtggaggtgacagagggaaattctgcatacctatcaaccattagatcatttgccctattttcctttttaatatttttttccacaacaaacgttttagtagcaatgcctgtcttatttgggacaaaatgcgcaaccaataccaaagattgctgactattcctagacagttttagtttatcaatatggtataattaaacctcatttccccaaatcaaatattaatattgtagatggtttttattcaatagcctttttttccttcttgagtgatatacttcttcgaaagtaacctctaagtacctgtaatgagggggacatgttgagctgcaaagattatgtaactattgaatggaagtgataatatgctcttaataatcccattaatcgaggcaaagtatactaagcctgaaactattcatctaaaatgctcacaggctgaggatgcaggattccttctagcctggcagatgcattttctttctactagcgagcaggtaaattgagttgcacagggcgaaccatgggaagtgggatctgatgcttccatttctccccagaagcctgcgtgcattatttcagaaatctgcctctggatgtcatgattgaaggagagctgctgtgcgctgtttactggggctttggactctggctaataaactcttccaaatcttcctagctgacaatgctcttctcatttgccctgtcatgaggtagctacctcatgagaaaattttaaagtgcctcaagcaagcaggtagcaagtggctgctcaagattaatttccattggcaagccctctgctgcagcatgagtctgaataccaataatgcaggattaaagaacaaaagcaagcaaagaaaagctcatcccagaggtgagagaaaggtgaattgtgcaaatatggacatcgaagttattcagacacatatggtttccatgtcgtgagaccttaaagcactctcagaaactccaagaaagctgttgattggtcagatttctcacttttgtyccctcaaaacaagattgtcctgaacttataggaaatatactcaaaagtagtatgatttaaggaagtcttccaaatacctgcctcgtttacagataatcaatggaattccaaaagattttatgtgttttaagccctaaaaatgcaaatatccaggaaagggctagcactaaacagagctggcatgtatgcctcagtgcaggtgtatatctcagtgtctcctgaagccagggccttagaggattgtggaaataggtacactgacagcagggactggaagccacagtctggagagcaaagagcagaatccatacttacacctcaagatgagcagaacagaacataaccattttgctatgagctcatctccaccttcttcaccaaactgcatccctgttacttctccactaacctcaggacataccaattcttctaaaatgctcagctctctcaagcttctgtgtctctccaaataatgctgtttcccttccctgcatttcttccttctccaccgtatttgacttgactaactaatatctagcagagctgtcaaccagttctagtcagtttttgctgctgtaacagaataccacagactgggtcattaataaagaagaagaattcatttctcatagttgtggaggctagaaagtccgagatgaaggcgccagcaaatttggtgtgtggtaggggttgcgctctgcttccaagatgacgctttgatgctgcattttcaagatgggaagaatgctgtgtccttgcatggcagaaaagagtggaagagaacaagccactccttcaagaattttttatagcagcattaatttattcatgagggtggagcccttatgatctcagctgccatgggtccccacctcccaacacttgcacttgggattaagtttctaacacatgaattttagggaacacattcagactgtagcacaacccctccaggaaaacctttctgacctctgctaccactgactctagactaggcttggtatctatccttgcttcccggcatcatgtacatatcaccattatagaattgaccactatgtcagaaatgtccttcatcacatggctgtctctgcttagacactgcctcctcctaaagattaaacactcatgttcaaaagtctttcttcatgtcagagcacagcaccacagatatagtaaacgttcagaaaacacgtagtgaaaggaagaactttaacgctgaaaatgctctttcctagtaacctctaatcatgcatttgaataaaatcaacatgtatatagatatatacacacatatacatatatatatatatttgttgaacatttaccagtttaaacagtgtattagtttctaagcattgttcttaacaaaatggtaacacgtgttttctgtcaagtaaagactacaaatgaaatggttgatatcagaatgacgcacatatgtagagaacaaatcaacatgtgtaccccgacatccaaaacaatcacaaaatagctttt

SEQ ID NO: 178 - DNA, 3001 bp, Homo Sapiens
  allele 1501: 99-15682-318 : polymorphic base A or T
  misc_binding 1482..1500: 99-15682-318.mis1
  misc_binding 1502..1521: 99-15682-318.mis2,  complement
  primer_bind 1184..1202: upstream amplification primer
  primer_bind 1665..1683: downstream amplification primer, complement
  misc_binding 1489..1513: 99-15682-318  probe
  misc_feature 1842: n=a, g, c or t
aacataaattctatcaaaaagtttgtacaaacccaaggaggttggtgaagaccatggttttctggtgattggggcattatccagattcaatatgttctgaatttatgggatcataactactttaaaaggcaccagctcttatatctaatattattccctactttagttcaaactctcatgatctagatggagctactaccagtgccttggctgagtgggattggagaaagctgaaactgacatagtaagagatagtatggaaggagaactaatggggtgtgggctattgatggcttatggaggtcaaaagagaagaagaagttgaggtaacttatttttgttctatactctacatgacttcgtagatgccaatgccttcaaaacacaggttttaaaaaatagtggtagaaaaaatgataaagctagtgtcagcatttgagtttgagacaatggtcaaatattctagtgaagcttttcacgttttactttaaatgtggatttaaaactcaagagaataaagctatagatataataacagaaatgtatcatatttacaaagaaagagagaaaggaaagctgatatcacgtctttgaggaaaggcctgcatttctatgttaaaaggacaaagatggagtacctacagacaccaaaacaacaattcaaacagatgccatatgatgaagctaataattgtcattattgatagtgctcaagtggtcttgcaaggtaaagaggatgaaacagattttataatttcaagatatgtttgaatagaaacaatttaaataaaacaaaaagccttttgagaagaaattgataaatggaaggtggatgagattgggtaacattgaaaatagcaaagtgaactacaataggaagatgtttgagggtgaaaggtcagtagataataatatagaaactcaaaagagtataaagttagtgggaagactttgtagaatgtattagtccagatggcataagttgtgcgttattttctatttaataagcacaccacagaaatatagcatttgtagttttggctcttgcaaaatctgaagagagctgggtgaccccctagggcctgctccatggagtgactcagaggggcagacatcttccaatgacctccatcttgacatctttcaatgacctccatcttaaaagtggaagcagcataaagatgtttgatgagcaacaagtggccacacaagtattggagaaaaaaaaaattagaatgtggggagagaggcagtagacacaataaaaaattctatataacaaatgctatatctttaagaaatcgaatctttccattaaatatttgtttaaagttacagactacttagatgttaaagtatcacttatcacaaagatcagtaacttatttcctctgtatagtagatgcctcttctgtagaattaacatttcactataatctctaagatacagttcaagggcacaattttataattcaaagatatttacggcatgaaattgagwtctaaaactcttgtatctttaacaaccattttgtaattaaataactgttgacatttacaatcattgaagaactatttgaactctgtagagtatagatattgaagtacaaaattaattatgagataatatatggagcctgtcggctttattttttaataagtatgtatgtatgccaataaaggcatttttgtttccttatgtaaaatgtcctatcacccctcagctgattttgctatatccacaaacactacagttagcagttgagttttcttatttgctttttctttaaaaattatttataacttttggtttctgaaaaaattggtaataaaacaggcaangtaggaaaaagaattatctggtggtagagcagacagaaaaataaacacttcagcatttatttttaatgacctagttaaccccactcactggatttatatagctgacagtttgacctcttttattgctgatatgaattgaaatttattccatgaactacacgattgatcattaagaaaataaagacatgaaaagtggcaagacttaatctgatctctgtgtatgtgatgcttatattaaatcttccaaatatataaaataaattcaaataattcaattgttgtagacacattgattacttaattgaatttatttatttatttatttaaatccagattaccaaaattattacctagaagaaaaagatattttaatcagaaaaataaaatactttattattctacgtaggatgaaatttggttcagaataacaacaaccattaaacgggaagaataacaacttaatttcaagtggaataaaattgagagttctttcttccttttttcttattaagaagccataagagatagtcatattactgatttatgggtaaataattttcatttcatacgctaagagattaatctggagtcagttggctttttattatttttgcgtgctttttaaatcagattttgaagaagtaaaagaaataaacatcaaaacataattaaaattttttatttataaagtgttgttggcttctgcctattacttaatattcattcggtatttggttttaaagacagattctctatgataatagatttaaggagggaagtaataagtatgtactataaactttaattctggatgcataaaatatatttttcattaattttgaaacactatctcattcaactaaatatcagaattgtacacttattttagtttttaaatacagttttcagggtccaggaccatggaatttgatataagcatttaaaaatgtgttttttctcatggtgaaagcagagacaaaagataatctgtaaaggaaaataattatatatgttattggttatctttttgtttgttagtgcattttgcttcattaatttgggaattatcaatataaatacagaacatagtcttcactagttcctatgggtttgcatgaattgtatgactgggaaaaatgtaaaatgcaagctgctctta

SEQ ID NO: 179 - DNA, 3001 bp, Homo Sapiens
  allele 1501: 99-20933-81 : polymorphic base T or G
  misc_binding 1502..1520: 99-20933-81.mis1, complement
  misc_binding 1481..1500: 99-20933-81.mis2,
  primer_bind 1563..1581: upstream amplification primer, complement
  primer_bind 1130..1149: downstream amplification primer
  misc_binding 1489..1513: 99-20933-81  probe
ttcttaaaatgcttcacctaaaatatacatatattatttttacctcatatatgtgtcatattgtatgttacatattatatatattatatataaaatatactgtagccaattatatttttgcagttttacaataagtacctccaatgttttaattctctttccctcaatctctttatttttattaatctagaaatgctcataaattttacttgaatgttttctcttccgagcaacttattttaaaatttttattatatttaagtacatgtagtatcctttattaactattctatgtacaaacatgattgttctaagatattcaaaattccattaaactaatttaatttttaaaaaactattcaaaagagcattttctttttgcattttcaaggaatcaaaaaacattttttgatgttgaaattacattgcatatttcaactaaagatatttgcaaaagaaaatataatttgtactataactaggagataatgcatatgagaaatatgtaaacacacacagagtattgaaaaaattaactcacctttaaatgtatggtgcatttttagtattttattaactgtaatattacaactactagattttactaatagaattgattttcaggcttagccacataatgggttccatgataatgagcttaagaaatttatcataaactcatattcatatttctgttaatattgctccatacactttatatattatatgaattggatctcttaatgcctcattgcttccttcagggtacattgtaatgatatgaattccttgggcctccaaagcaaagggtctatagtctgaagttcctgtccatgggaatgaattctaccattataactcctatgggaatcaaaagggccacgattgagtgaatgcatgttgaataaataatctccctaatgtcaagattataatgactgttgaaatccccttgtatgctacttgacactatctatgacattttcttcatccatataatacttattataatcatttttgttccttgagcttctctttggcagcataaaatatgaataaataagcaattgataatccaaagtaaggtttgcaatattttttaaagaatacataaatttgctccttgattgtgtcttctacaaaatgttctcccagaaatttagagaattcctgatgtatgagtaaagataagacatgggatcatgttcatgttttctaggccagctttaaatcttggaagctacatgatttttacaggattttctggaagcacccgattccaggttaagtgttgcaaatgaaagaaaatgttcagatgtaaggaaatacgtctagcagtaacttcactattattcttattctttttatatatttactgattactcaggcccagaaagagccttgccccttgtcttgctgaaagcaatagtctggagactgttgacttggcaaatatatctcagtttttttggagtgattctgacacttgctaccccagcakttactgaaaatatacaagcacacaaaatcatacaaaacataacagaaatagtaaacacatagtttctcatgtgaatggaagtgtctcccagattaaaagatggatcctgtacatttaataacacaatttccagctctgaaatccttctgctgattggcaaaatcattattctggtattatcctagaaggggttgacttttataaacattctcttttacaggcatttatctttccttttctgaaatacccattttagcactttgtccctaaacaaaccaaagacataaaaaatcaatttttgttttaaaaatataacacagccaagcaataaatcaatggtatttccaaagtcctttgcataatttaagacctaagtcaataatggtggcatagcttcagttgttcatgtattattatttgtcttcaaatttttgccacatgtaaggttaaaatttcacataaaatctatgatctttcttatggaaaaaaagtaatacttcttgaaaagtaacaatagtgtaaattatactgaaagccattctacactaacttgagtaaacatttctgacatatgtcaagtgagcatgtattatagctatagtgtctttagcataacagcagatagacttagaaaactatatgtgacacataataggtactcatttaatatttattaaatgaataaataaaatggaacattattcttctgtcagagagggttttatctctgaaaatgcctttgaaatcttgaaatgtaaagattgttaacttgtgactttcaaagcttaataggaaggtagttctggtgtttcccaagtatgaaacagaagtacattcaagaatgttaactgaaattgataacaaatatcaaagcaaaacttgaatcgttactattaactgacagatctatcaatattacatgcttaaaatatgtgaacaatttattaatacattttctaaaggcttatattttcaaatgttcaagaatagtttattatttaattatcttcaatgtaattaaagggttaaaatatctgctcatttacatgtgaatagttgataatgcggaaactattttaatgttccaccaaaaaaaatcaaattacctgggcattgccaaaacacaatttaatttttttttgtaaacagatatttcagtaacaacaaagtttaaagtatattttccttaaaatctaacatgatattcaagcccatcttctaatttgttttggagggcaggtagtagaagccactgtaaataaagcttccattcaaccatatgcattaataatgttatttattccaactgaattccaacaggaggtagcaaggtacaaaaaacaaaaaacttgcaagaatcaggaaatctgggttcaaatatccaatttgatgtctgcaagatgaataagctagaaaagattgtttatttgtcattagttttattaagttgattaatttaaaattaggatggccaatggcagagagagctacgttaatgac

SEQ ID NO: 180 - DNA, 3001 bp, Homo Sapiens
  allele 1501: 99-25029-241 : polymorphic base G or A
  misc_binding 1502..1521: 99-25029-241.mis1,  complement
  misc_binding 1482..1500: 99-25029-241.mis2
  primer_bind 1722..1741: upstream amplification primer, complement
  primer_bind 1292..1307: downstream amplification primer
  misc_binding 1489..1513: 99-25029-241  probe
  misc_feature 1368: n=a, g, c or t
ctgctttcttctgaaatcatattcttctcacagacttggtacaaccacccatacaatatttggatcccatatgatgaaagctctatgttttaattgctaggcctaatgatatatttagtttgtatcatgaaatatcaagttaattaaagatagtgagtgattaacaaaacttgctttataggtcctgttctatagatctcaatgtccaccttgtgtcctgctgttgttaactttttcccattgagtgcatcgtgtgctcttaaactccacatttttcccttcaatgcatgcagtgagtgggtctgaattagaagaggtctgtcttcgtatagtgaatcctccatgccttctctgagacaaggaagtgattaataaacttaaaagttggtttccctttctgctagctcctgctgggcaactgtaaactatgacactatttatgtcaacaaagtataatcagcaaagggctaatccacatgctattacccagagttaactgtaacagatcaatttctatgtatagttttgaaaacttgtcaatatacagcagccacagaacccctgagcttaaccagatgtaagaatctggctggcgctgtcagtccctgaggaagccttggccaagcttgcaaaatctttgaccttattctcaccctccaacaacaggagcaataatccaaagtgttttgtctttcttgtattgtagctcatttttttttcctacagaggtgaaatttccattttgtaatttttctttctgcactttttctatcaatttttttttcttggaacttggtgaatagaagaaaatgctttttatttaattcttgagcaaaagtaggataggaagataagatgtcatcttggcaggttgaaataagtcaggaagtgtgtgttataataccttacagatgtataacatttcagtttacagatctatcctgtgttcatcagctcaaacctcagcaggtcccagtgggataggaggctcagaaagttgaaaagtgtgcctgatatcacatgcatgtggtggttcaggaatatatacctaacacatacctagcatcacctccgacgcctttccacagctgtctccctacatgccttagtatcatgcagatcatgtggaataaggtaaaacatatgcgtttatttgcttatttttaattgctgtttccatttacttgatttactgttatgttgtctatactgttgatctaaagtattatattaggtagtatttctttctcaataattttgcttcacaatcatagttctaattccttcataggcaaataattaagcaactccagtaatatttccaaatcacatactgaggcttctctgcatagggtgctgagtcatcantgttaacactaataattagagttcaaggggaggggctgtccaggggtcacaccacgagaagctgttttggggtaaaatgacacgatctgcaccacctgcacttagtcagaagaagggcattgaaatggtgccrtgaacagctatgatcctggaattagaaaaaatagaagaaataaatgataatttccagctttaaaatgttaagaactcaaagtgaagccacaactgatagggagagatttatatggatattggaatctatctgaggtcagtgggtccagtttgtgtcaataacccacgctgacctctgtggcaaagactcaggcaggatgacttcctggtacactcgatgaggataaatcttacacataggtatcccagaagtcccacttctcctctgatccagcaaagcatgagttgtcagaaagacactagtccagaaggcactgaagggatcatgtcggttcagaccaacagtatctaaaacatctaagtcatgggtccagcataggagagactgaaagtattctagaatatgcacaactgtggagcaattaggccatctttgacctaactttttcacaatactgcttggcagagagatggtgcttcctagaaagaatatataacttcagcttctcctggaataccatttagctttctcagacatcaactgtgtgagacacggatatctcatgaagtgtatttagatcatgacacatgttaaacatgttgggataaacatggaaatgtgtttccctcgattcattaactgattcaattccctccacatactcagttaaaatatcagtgcaagaagtgaaccgtgatgatagattaaaaacacttgtgtctacttcctttatcatttattcgcctctaaaataaagaataattaattatatatttgccagactcttgtgtggacgggttgggccacatgaccttcttctgacttagcagatcgctggagtacactgcaccaccaggtacattctgggaaacatttttctctttgagaaatagatgtcactgtaacctacaaaggactgtgcaggagatgtgtatgttcttagtcatatcctaaaatggcaactggatatctactgatagctttcattattcttctgaatctcaggttcacttcaaatttatggaacgttctgtttgaatacacatgtgttcctgactgtagtccttacacgtatatcctaagagagcttcctctttagtattgcgaggtgaccttcttgtattcatcattaattgaggtgggatacaaattccataatgtcaccgagttcttaacccacttatttcactgggttaagaaataagctttgttagaaaaactaacaagacaaggggcagcagcaaaagagaaaagacaagttcctctcatcgctcattttatttctggagggggtatgcctgctgacattttatttctggagagggtaatgcccacgtcctgacagatatgccagcctctgttgcctccatactcacatgccaggcagggagcaccctgtccatcagtcttggaaggactgcttggccacttggttgtctgggtttgcatggcagctgttcagttatattaactcagaaagcaggcttccaacacccagga

SEQ ID NO: 181 - DNA, 3001 bp, Homo Sapiens
  allele 1501: 99-25869-182 : polymorphic base A or C
  misc_binding 1482..1500: 99-25869-182.mis1
  misc_binding 1502..1521: 99-25869-182.mis2,  complement
  primer_bind 1320..1340: upstream amplification primer
  primer_bind 1849..1868: downstream amplification primer, complement
  misc_binding 1489..1513: 99-25869-182  probe
cagctatccagcagttaatacactaaacaaaaccaatttaaataatagttatcctggcagaattgttgaaaattctacattgttttgactggccctagagaaaaatctgattcaaaaataaccaaaaatattcaatgaaaatatataatattctaaattgaaattgcttaagttgtgtaacattttcttatcatgataaaataaaaatctagaacaaggaaatcataattattttcctttgaatatgatgttttatgtacattttatacatatatttagactgtaaaacaattagaataataaaataataaaactaagctcaatttttagattatgtatccactttgtcttttgttaaaacagtatttttttggtttcaaagaaaatcttttatataaaaattgaagaaaaaaatacttaggcaatattataaggcacttcctggatcaggttataccaaaacacacataccacaatgtatgtttctttgaaaataatatatgtttgaaaataatttatggaaattatatctctgttttcagtaaataatgacaaatgagctcataatttaataaaatgaagcaacacacttaaagacactaaaaatatttttgatagataatatcagacacagatatcagtacactggaatgattgactatttgtaacatatattactagtagcagcagtgagaggtagagagtagataaacataatagaaatatcaagattcttatgacttaaaatttaataagtcaaaaagaacaaatggaattttatttgtatagtcttagaggaaagttgatcgaccagaatgaaaactattcgtacagaaattaagaatgtaagaaaataaattgtgccgaatattgtaatttaagagcaagtatttatactaaaattgattagaacattagaatttctggatcaaatgtggactgtcatatattatcagtggacaccagtggaacaataaccatgtgaagattttggagactcctgtctcctccaatccagataacctaaaatataacaacagggagggatgttacttacaagacgtagtaaaactcacctgactaagaagtcctgcagttctgacaatgagtttgactaatggtaagagctgtgtgaataggtagtgacaagcagctctgcaaaaccattagtttttgtttgttatatttatcaaattgacaaacatttttccagcagcaagcatctccattcctttgtatttcttttacctacctagcaaaatcagtttataattccaaaggcagaaactatttcattcatatcctgagctcttagcatgctttggttttgtagtgatgcggtaagggcagataatgcatctgcaaaatgaatgagctgctctaggtagaacataaaacagttctttttacatgatctacactatttaattgggtcataatcattttctcttagttatattttatattaacttttattaaatcaatttagcataaatgttamattattatgtgtttaaatatcacccatcatttctgtaaaattgaaacaaagtagaaacaaattaagaaagcagttgcttttcttaggaatctttatactgaaaaattccttaacttgttccttcttcccttgctccctttcttttctccctttctttcatcttccttccttcctagcttcccttcctcctctcttccttccttctggacaaatatgtagtttacttgatcttgtttgtagaggttaggagaacaagacagaaatacaacactagtgctcatttagctttaatcattttggaagagatgtaagatacaaatatgaatattatgtaagataatttgagtgctatgattttccctgggtctataaagactcacacttcctgattttcctttgtttacctaaatctagtagctaatgagtttcacagaagacaaaattcctacatcaaaataaaatttccctttaaattacctcaactagaaaatccttgtagttctcatgcaacccaatattctgagcctgttcccccatttcaccaatcacctttacctccttcagtccccaggctcccaggacccttttaagaaagcctgtggcccttacttaaagaggaatggacaccgatacatatgtccagcagaaactggaagtgatgtattacatctatgtgcctgttaataattaaataaatactttaaaaaggtattgcaactgctaaaaatctaagaacgcagtttgaaattaaatactattaatatttactttgaagtcattgtttttcttcttataattcgtattatgtgggttaagctagcaattgacttttggagtattccagacatgagatcattatacctctggatttctataaaagttgttcaccactacaacctacttgtctgaagcctggaacaaggggataccttcactcaacaaaagaaaataccagtattccagagcctctttagacagaaaattctgaattgataccttgccatgaatttggttgagagaaatgctatggagaggatattatctttattacatagtacacatttactcttctatgtattatgagttctatctctgagttcatctggtggtcagaaatttgaccatttcactgtattaaccaattcttttacagactatcctttacattttggtatttatttcacggctttttaattttaatatatcttttattaaagcacatatacttacagaatactgcccatgagatgcatgtacgattagatgaaatttcatgttactgacatgaagaccaacaagaatattacagggttgcctcaaaataattttcgtcttcattttcttaatacagatctttagaacctatgaatttttgccttcatttttcaatggtatttttcctgggttcaggatttttggttatttccgcttagaaagaagtcaatccatcgtctttttactttcgtgatttctattgagaagttggctgtcaatcttatg

SEQ ID NO: 182 - DNA, 3001 bp, Homo Sapiens
  allele 1501: 99-25881-275 : polymorphic base G or T
  misc_binding 1481..1500: 99-25881-275.mis1,
  misc_binding 1502..1520: 99-25881-275.mis2, complement
  primer_bind 1227..1245: upstream amplification primer
  primer_bind 1693..1713: downstream amplification primer, complement
  misc_binding 1489..1513: 99-25881-275  probe
taatatatttaaaagtaagcatctttttgggtgttatttgctcagaaactgtaaataaactactgagagatgtcctagacttatcttggtgggtaaatacatattttttgtatatacacacacacacacatatgtatatatatgaaatgtatccaaaagctatataataacataagaaatataataattcttatacaataaccaccacccttataagacgattcatgattttttataatttgcaaagtaggtaagtttgctgtgctagatattagagaagagtcttagttatatttatagaagtgattttattaaaaaatcaggacattttatgcatattttattatttactttatcagtcatttgctttgctatttttctcaaaatggcattttaaaacttcatcccataaatagtaaattctcgtctttgttaaatgatttgctagtctagtgcctggttggcaaaatcagctttgtaaagcaggttttaagatacaggtggaaaaattaatagtaataattatttcactgtagcaaaagctttctcttcaaaattaaaattaaacaaagttacttgtgtagtcaggaaggatggcaaaggcagcaccgcctcctgaaacaatagagtcatcaggcacgttgctgcccccgtctaatttgatgtgtcaggccctaatcagctctgtttcacagtgctttgctccataaaagcagatttgtttaaccacaacctctatttcagcatgactggagaaggaagaataacggaggagaccaggcatatctcacgtgttgtgttgtgggtataaagtgaatccatcatttgctggagaggcagaggaaaagtgacaggctcattcatgccttcgagacatttttgggtctattgaaaattttaatctgtgcactctggttgaacctccgcactccttaatttagtacacacagccatgcgctaggtctgtctgcctcagatagggccggctggcttctgtaggacagcaacccccctgaggagttttcttctctaaattcatcctgccttgaactttacacacacatataagctccatttacgggaggattccagagttaattaaacgctgaatttgtttctttagaaatcgcatatgcctcggggttaaggaatagcgtttcagcaaccacgttaatttaggattaagcatactgtacattttctgaataaattttatttttataagtatacattgagagagatggggaaattttccccctctgttaccataaaaggttttaaaaatagatttaaaaaggacaccatatgccaggagatgctgcaaatcagcaaattcaaaaccatcctttacgtaaaatgcattggaaacagacaaataaactagaatgctggaaaaattgttgctttgctgataaggccatggaacgacttccaccggaggctcccagctttaagtcctgttcactctggatttgctctgtgcacaccacggtaataatckcagaagcataatatttacaaatatttgggtcaaagatgacaggtcagatttttattatcaaactagcaagtcaatactgacatatactagttttagttccactaaagatactacatataacagcagacacgtttgttcttaattttcctaaaggtaggtgtttggcagaagataaagcctgagcaaatagagaacagaagaagccaggaaactggtattgtcctcggtggatttactttgaaacactgtactataaaaactttgcaagtaattcagtaccttgagttcattttcattgatatctttgcacatcatgtacaagaaagttgtgttttggcaaaatgatcaatatcttaagtcacagatttacaaaatgccagagaatattctttgcattcaaattaagagagacacagaacatgaaaaaaaagtgtatttaaagatctcggacaacctcgacctttttgtttatatgtttagtttaaattattaatgacatgtatgtgttcacttcaacatggaatgtttctttcctttcctgttctttttctctgtctgtaaagtttgaaataaatcagtaaagtttgaaataaaaacaattgttacagtttctgaggtagagagacaattaggtagcatttggcattttctgtaggtcagatgagcgtatggattcttggaggtaaaaagttcaattcatgaagaagaacagagacaaccgaaggctacaatgactacagtaaaataaaacagccctaaagcccagccgagtaagccctcatccataaatcttattaatcagggctacttcgaaatacaatgagcaagggagaaaattatgccctatttcagacttgcccagtttctttatcacttagaagaaagacaaaaaaaaaaaaaagaaattattaggaccatgtaagacagataatcaaatcaaggaacaatgcaactattgtcatatgtaggatagaaactacgcatagtattttgaagaagcataaatagcctatattgatatgtcaaatttttccatttacagatgtgcggaatttctattggttgtgtgagatgatctcatttttagggagacgtagctgtatgtcatttatagctgtgatttatattgcttgacctattgaggtaaaaatagtggttgttctaagagtatcccctgtctgaatgcattgtgcagagtgttcattctggaacacttgctgtttcagttctgattcattttgagaagaattccttttccggacttctataaacagacattggcaaaggaaattaaataaagcaaactaagatgatctaattgtgagtgagtcaaagcctcataaagcattataatttggatattttatcttaatgtccgagaggaagctgctattaaaccactagccttaagcaaagcaacacatatgtaataatgcaaacgaagagaatcagattggcccattacttgataaaagttaattgttttaatgaatatttttg

SEQ ID NO: 183 - DNA, 3001 bp, Homo Sapiens
  allele 1501: 99-25897-264 : polymorphic base A or T
  misc_binding 1482..1500: 99-25897-264.mis1
  misc_binding 1502..1521: 99-25897-264.mis2,  complement
  primer_bind 1242..1262: upstream amplification primer
  primer_bind 1736..1756: downstream amplification primer, complement
  misc_binding 1489..1513: 99-25897-264  probe
aagttaaaataatcctccaaataatattgtattatatacatttatgtttcacttaggaatatgtttcagttttaaaacattttgtttatacaatacaattttataaaacctttccctatgtaccaagttaatttttagatgatatacatatttatggtagatgtgagtgaaagctttgtatttgtatgcttcttagttattattgctagtttttgaaaaatcttgaatatatttctattagtcttaatacacattaattgtattcccttggcttatttatatagtaaataacatttgcaaagataatttttaataaaatgttgaaacgtttccatgttctgttatttcagctaaaaaataactacaataaaaacagtgacccatgtgtcccaagcactcttctaagagccagaaagacagctctaaaatatcacctctgctattataaagtttatagtcttactttataccatatttatttctattttgatagttctgatttattcttttattctttaatatattgttatatattacttttcaaaggatgagcttcagtatttataatgtctttttttctgttacctatatcattagcatcaatatatgcattttttttcttattttcatcttattggggctacttttagtctaacttattgccttgagtgcctgttttttttttttttaaatctttcaaattggtttgaccataattagactaaggtttattgaggtggcatctagagggtgttaaattttatgcttcctatctttttttttcctatccagaccctatctatagctatagatagatagggacataggtgatggtagagatatagactagataaatcagaactctgagagattagaaacttcaacatccacaagagagtaaacaagggaagaaagaagccttattctattttgaggtctttctttgaacattacaaataatttctctccttccactgcctcctttaatttatattggggtcccttagttctgggtcaatttgttaaaatgagcaggttatgagatgttgagtgaggagcccacacgactgtcctcctgaggtcccgcactgccatctgagcaggagcaggcgtctgtcacgctgaagacctgcgtgctactctgtggtttcagaatcctggtagaggagagcgttactttaagaagcagacacgtgagcctccagatgcagccaagcatgaaatcagctcgggtggataaccttgaacagcgacaaaagaacaatctccttccaaactgggctaggaatttgtattactgaactatgccaagttcgaaggaggcaagtacggttgcttgaaagttatgggaaacaaacaaataaaaactaaagaaatccagatctttccaggtgtagacaaatgctctatttctggatgacaggtttgatttgcttaaacacatttcaatgaattgaaggttggagttgagagtgtgtcgtgacacattcctgtcttaccwgaataggggggaggaaattgctgatcccgggagctaaagcaccttttttcacacacgtggtcggcctttggcacttttgtcacatgcacattgcctgccagctcctccaccctccactgggtgaggagacgctgctgccttgagtcaggacctgcattaatgggggcgtaaggtttttactcagcggaggagacacccccacctagtgaagctaaaactgaaatctgatcatgagggagaggttgtgttggtcttgccattactatgtgttcatatcatatgttaaattttacgtatttccttttccacttatcagatacactttatatcagtgctttcctccgatgaattaagattgtatttctattttcaaattatttaaaaaattggaaatctttagagagaaatgttttgtaccactagtttgttcttactaccagatgagtttgatggtggggcggaaagtgtttctttaggttggaagttagaatgtattctcgaaagtttagattctcatctaaactgattcatataaaccaatagtctaacaaagaaaatgtgaattcacttacgtgttttcatttagatgttaccaacaattattctacaatttgtaagaatgtgtgtgtgtatgtatctcttggtgcgtgtgtgtgtgtgtgtgtttggtgtattattaattctatttcttaactattttaggtgtttgtaaattaatttgacttagcaaattctggaagccatattcatagtttttatttaaatctagacacataaagtcttttttattaattttctcatgtcacagttttccacactcactcattatgtctaaaacccagtagcttctagaggtaaattgctttttaggagaatattcgctaagtatctacactctattttagttccaaaatcttttaagttggaaatgtgcatgtgcctgggaaaattgaaatcaaaattaaattttctgtcaaggaaaatataaaatttgaaatcacaaatgactcattcctttctaatgactattttgcatcactattattaatgacgttttagaaggtttacacacattcaaaatgttagtatcttttgatattaacaaatgaagggaacactttcgacaatcaagctttgggtattttttacatttattaaatatgtgattgaaatttatttaataagcattcctgaatgacaaaaataatttaaatgctgctacttttagaaagattagaagacgtgcggcagagggcttggggtcatgagtctggagtattggacacatatactagttattccactaactggttatgctaccttgcaaaatccttaatagggctaagctatattagggtcagtttccacatgcataggctgtggtgtttagaatgatctatttaaaatttatttcaaaaattgtattgctgtaataaatgacagttgttattgcaaattcttctattattattaatattatcaacacattaatgttaaaac

SEQ ID NO: 184 - DNA, 3001 bp, Homo Sapiens
  allele 1501: 99-25906-131 : polymorphic base G or T
  misc_binding 1481..1500: 99-25906-131.mis1,
  misc_binding 1502..1520: 99-25906-131.mis2, complement
  primer_bind 1374..1392: upstream amplification primer
  primer_bind 1888..1908: downstream amplification primer, complement
  misc_binding 1489..1513: 99-25906-131  probe
aagtaacaaagacttgaaggggttaagtgactgaatataaaaccaggaaatgggcattggtacaatgtgcacaacttattcaggttttgccaattttacatgcactctgtgtgtgtgtgtgtgtgtgtgtgtgtgagatcgtccatgcaattttgtcacatgtgtagatttcttgtatcacaaccataatcaagatttaaaactgttcttcaccctaagattccctcatgccctacatcaccatccccaaactctgcccaccactaatctcttctccatctctataatgttatcattttgagattatatatatatatatattagatggagttgtgctcttgttgcccaggctggagtgtaatggcgggacctcagctcaccgcaacctctgcctcccgggttcaagcaattctcctgcctcagcctccggagtacctgggattacaggcatgcgccaccacgcgggattaattatgtatttttagtagagaccgggtttctcaatggaggtcaggctggtctcaaactcccgacctcaggtgatatgcccgccttggcctcccaaagtgctgggattataggcgtgagccaccgtgcccggccgagaattttatgtaaacagaatcatacagtatgacttgtgcatgtcttttgagagttagcttctagactcagcactacgtccttgagagatccctccaaattgttgtagttgtgtatatcaatagttcttcagcttttattgctgtatttcatggtgtgaaataccataatttctgtaactattctcctattgagaaaaatttggattgtcctcattcttgactattataaataaatctaatatgtacaagatttggggaacgtaaatttatgtttctccgaaatatgaaaccaaaagtgcatatattaggttgtgtggtaaacaatgcggttattcagacagacaaaagtagatagagctcagagtgacagggttgtgttgtgagtaaggatgtgttctctgagaccaaaatgtctttgttttatatacgagcttcacaacctgctactcatgggaccctcagtgataaaaatgaagatgataataacaatgatgccatttcaaatggaatcattgtgatgattgtgttagttaattcatgacaagtccttagacctgtaactaacaagcaataagttttcaataaatgttagctattattgtaattgcataactttggacactagtcatattaaacactttcccatatatttattatcttcttgaatttattctcttgtagaaaaatgttcatgcttaaatatactgatattatctaagaatttttattactgatttgaataacttttatagggttttggaagcaaatgccgtcaactgtttcaatcaatattaatataaacaattgtgtataaaaatcaataatgaaattttaaaaaaattcctaggaatgagactttttataaaatttacttattttatgtttggaaggctagkcaacacattgaaggagggtgttaatgagccagcccatatgaacagtgtggtgcccaaatttcctatgtctgtgaaatttcatggcaatctgtcaaaattagccaaacttgtttccattaaatacactggtggtattcaaataatttaagttctggttccaaatcgaatataaaactgtgctgaatataaagaaaaaggaaacctcaaaaccaccttcaaaacatattgaagccttaaaatatttctggactttttaaagggtcccaagagtagagaacaaagtttggtgacagtgttttgaaatgaacagacaagggcactctctggacataatccctcaggccaaatatactgtgtaatttggctgacagcaccatttccaatttctattttgcttaactccaatgtgtttaataaaatgcaacaaaaagtaaatacttacttcagtgagcttatttttccaaaagcagcactatgcatccaccttatgtacccatagtaaaacttttgttatttttatacaattattataaattttggattttatattaattcattaatttaacacatatcgtgagggcttgctgtatacacagcactaatctagccactaagatcatagggttgagcaagagagagaaagattctgctttcatgatatttattctgttgggaatgttgacaaccttaatggtaaataagtgaatgaacatgagatataatttcaggtcatggcatgagcattgaatgataatgaggcagggtgagggtatgaacagaaacagatgtactgtcattggtgatcagagaagttctctctgaccaggatagaagcccagaataaaggagaaaataaggatgcagtcatttccagaagagattttcaaccaaagaacagaaaattttaacgcactgaagatgaatgggtgattgatctcagggatgaggttatacttaggtcattacatgtggttttaggcctgtgtgaaaaaacatgaagttgttccaagaagagtttttgtaaggtagcctctaaacctttctaagctcccagtttaatttccaaagagcccacagtggaaaaggacaaagcattgggaattattgcaatcattttttgtatgctctccttttttagtatagtgtgcattcctcaaagtagtaaataatggtgttttactcatctcatagggcaaaagattctagatctctgtggggtaagtcaggcatcaagtcaatgtgtgttgaatgaaatatttttaagtccctgagattaagatcattttgttccacagaacaaaatggagccactgtttaaacctgttgttacacattttccatacccagtgtgacccttaatactgagtgtcaacttgattggattgaaggatgcaaagtattgttcttgggtgtgtctgtgagggggttcccaaaagagattaacatttgagtcatggactgggaaaggcagttctaccctcattctgggtgggcacaatt

SEQ ID NO: 185 - DNA, 3001 bp, Homo Sapiens
  allele 1501: 99-25917-115 : polymorphic base G or A
  misc_binding 1502..1520: 99-25917-115.mis1, complement
  misc_binding 1481..1500: 99-25917-115.mis2,
  primer_bind 1595..1615: upstream amplification primer, complement
  primer_bind 1115..1135: downstream amplification primer
  misc_binding 1489..1513: 99-25917-115  probe
tatttacctgtatcaaagtactagagatcatgtctgcttagttttaaattccacattttctctattcccatagattttagagaagtatgataaacatattcatagtatgagattttaactagttctcatgggcatgctttctgagttcaatgaggataatttcaatcactcatgtgaatatataaaataataaattattgatcacagacacaaagataaattttgtcatttttctaaaaataaagaaatcactatttacaatctatctttgtgttcaatgctattgtaaaaactaaaaacaaaagcaaaaaaccctctaagacaaaaatattaagacgcatagtacttcatctcttgaaacacaattatgcacactttgaaaatgcccatctaggtaaatttagggtccatggttttaaagtagaaactatactcccattaacacacacacacacacacaccctatgtagagtttgatctcatatccccaaaacaaaagtttttattgactattctaagttcactaaagcatattagaatccctctgctatattattattataataaattatccctcgtttgtatataaatccattatgagaaggtgttgttggtgattaggacacatttgcttttaaaaaaacaagactattagaagttctattatattctctcatgcaaataacattcaaagtttggatgttaaatagaggcatttccaggcacagatcaactcttcgaaaattattgtaggaggcactttaaaggaaaaaaatatgtttggcacaggaaattacatttaactaaaagcattttttaaaatgggcattaacaaattagccgggaatgcatcattcccatcttacgctctcaagcacttaatgcggatagacctacaaatcacattatcatcactttccataccttcatcaaatgtcatagcaacagctgccctagtagctctgagtgtgccttaggctaaaggagacatctgtttgctgacaacttcagatcaaatgacaaatgggagacagaaatgtctgtgcatggtaaggtcagaggccttacctatttgttagtttcagttgtaatagggattttcttcttttgataggcagggaaatgactaacatactatcagttagtgataatactaattcttcttcaatcaaaattaagtagggttacaaaaggaagattattattgttttgtgattgacaggtgttagttgacactttttttttttttggtttgtgttgacattcatcatactttaaaagtaaccacagatgtttcttttagtctgatcaaaatgaaattagggactataggttccacttcttttgagctctaaagagagtggtcttttaacttaagggttacttatttaaaatattagtttagttctttcgaactaagaaaaaagtctatttacattgtttatagtcactgaatgtgaatgcccatttttaagtgaaaataactaatgtaaatagcaartaattccatattttagtcacctttaatccttttttaaattcaggtgagagtttggtttctgtatgaaatcgccttgaagaatattgtgctattcctcctcatattgtttccacccaaaatgacagagacagatactgtgtgaaggaaaagttctcaatgctcaaagaaagatgcccgaagcctttccacagagttttgattctgttaggttttatcaagcctgcttgagatgccatccttttgtgagagagtcttggtgataaagaaagatgacatgggttcctcatacagacgtattttatctctgacaattcctgcgttatttttgtaatattttttggttagtttatgcttcattttcacatgattctatgttgtttcttttagtattattttttcttaagtctaatgtagtcaatattattgaatgatttactggtcctgttaaatgattcattttgaaatctacaaattctaatgtttttatgagcagattaacttgtcaattagatatacatgtaaatttagctttttacttttcttttttatttcagtgtttatctgtttatcctgttcataaaactgctaatgtacagggaaaatgcctaaggcaaacaactttttaaaatgcagggaagaaaattattccctgtgtttcttccttttcagctattctcttgtgaaaaattctcatttttttcactttttgctcgctttattattttaagtttgtcttgctttatattttattcaatacataacaaacttacttctcagtaagaaggtaatattaaattttggagtttagttcaaaatcaatctgatgcaaaaatctttgatagattgacattgcttcatttattgcttcatttggcatacatttatttagtttctatattttcttactgcaatactaggatctcaggctagaaatatgagtgggaactaagtctatccttcagaatctaaaaatctaagaattaaatatttgaacactctacatatattttgtgagagtgcaataatatgagaaacataaaacagtggtcaaagcaaatttactttagatggtttttaagaaggagtcatttgtgctcaaccttgttaaagaattttatttttatgtttatgagtcaccttactctctttcactttatatattctgttttaaaaattacattaaagtattcgaagtacttttgttttcttacctctctgtttggatgtcctacgtttctttgatcattttctcaacaacaacaaattaatatagaattaggtgctatatctagacacagtcattaaaatccctcaaatgtgaagcatgggataaaatataaaaggccagaggcttactgactaattgaaaatatagtaaaatccttaacttcttttaattgaaaacaagactttcttaagtctacctgtaatttaccagtctattttaaaagccacattaagttatttttagttttttaatgtgtagtaaactaagacatt

SEQ ID NO: 186 - DNA, 3001 bp, Homo Sapiens
  allele 1501: 99-25924-215 : polymorphic base G or C
  misc_binding 1482..1500: 99-25924-215.mis1
  misc_binding 1502..1521: 99-25924-215.mis2,  complement
  primer_bind 1287..1306: upstream amplification primer
  primer_bind 1717..1736: downstream amplification primer, complement
  misc_binding 1489..1513: 99-25924-215  probe
  misc_feature 1914,2542,2811: n=a, g, c or t
aatttgtcaacctcaagtgacatagtaaacatgctgagaaatagcaacttttatgtgaaaagtaatcaaatgttttgattatatgattccaaagagttttgggtttataaatttcactaaaaaaattttacaacacatgtactgatcgttaataaaattcaaataagatatatgtttttaatatatggaatgatgaattaagggagataacagcgtgttgccttgaattaaaatacgcttactctgtgttcagataatcatcgaagggaaagtgcttgaaaaaataatgataatatttgagataaggtaaattacggctgtcacacactaattaaaacccatagatcaattacaagatgagtcaacttgaacactgcatttagtgggcttatctgccaatgcttcactagctgtcctgctgttaaatcttctctgaccttctttcttgtattcatgtaagcgctaaatgatttttccagtagagcttgcagtgggactgccttcttccctccaggtcttccacactctgtcgggaaggtggtgaagagacaggactgcagccctcataaaggctctgcaggtgctcctcaatactggcctttagggtgaacttgacagaggtgtaagcgtcgagaaagaaactgtgagaagttccaataatcaagacagatgctcttttatgaagtgaaatttcgaccctaagacaccatctcctggggtcacaatcattccaacatattcttgatggaaaaggctaacatgtcttcctcaaccaccatctgaatgcacttggcacatcataaaagagatgagtaggaaacacaggaacatacaagcaagagacagggtcaagtgggagatcctcaagaaatactcctgagcccactgtttgaaatggtcacacatggttttagagttagaaatgaaatagtaagaacactagcaattacagtgatcatgacagcaatatacaaacatgattttttttttcattgagtaattatttttttgagacagggtctttctctgtcacccagtttggagtgcagtggtgtgatctctgctcactgcagcctctgcttcccagactcaagtgattctctgcttcattctccagagtagctgggactacaggtgtgcaccgccatgcctgactaacttgtgtattttttgtagagacaaggtttcactatgttgcccaggctggtctcgaactcctgagctcaaagagatctgcctgcctcagcctcccaaagtactggaattacaggtgtgagtcactgctcccagctcttcattgagtgactattattttacaggcataattcaaagtgccttacaagtattaatgcatttaattcccaaaaaatcccatcagattttatttttcatctctgtttcatagcctatagaactaaatcacagagaggttaagtaaccgcccaacattacagttagaaagaataataatcagtatacaaatgcaagcagtttctccccsgatccagcctccataaccatgccagaatgctgcctctccaatacatttgaacttttatcgggcattaaaatcaaacagcatttgttgataaataacaaacttctttggtctgaaaatttaacacattcaaacaatattctgaaattttcattacaaaacttccttgaaagcaaatcaacctggttattaacattagttgttggaccctggcgggtgggtgtgaagagttgaggaggggatgaaaagataaagcaaaaccaaacaaacaaaatgaataaaaacactttgtgtctacagtgaaagcacatgtgtggtaggtttccatttttgtgcaagagttatgtgaagggttgtcacaaaattaaacgtggctctttcagaatggtacaaagtctgatggatgcttaccatanagttagctctcctgtgatttttgtttttttgcaatgactatgaggccatacaaagagctcatgtattaacttgaaaactctggcttggagggtgatatagtttggctgtgtccccacccaaatttcgtcttgaattgtaacacccacatttctattagtctaatatctgggtctttctgtgataggaaaataggggagttaagaagtgggtagtaagagtgaaaactgtgctccaggatatgaatgggaacaccagcaaatattggaggtcaagtcacctgtaagtttcaggattggtagaaataagaacatgagacttgtcctgagacacagaaatagtgatattgaaaacagttaaatacctctatgccatgtgctccaacctatgagaaaagctccataaacaaccaacatgttcatacagtggttccttgtaaggccctctgaattatgccaggaaaataatagtcactcaacaaagagccaggagcagtgactcacacctgtaattccagatattagactgggttccatgagaggagcccagtgggaggggattgaattatgggggcgcgtctttcctgtgctgttctcgtgatagtgaatgagtctcgcgagatatggtggntttaaaactgggagtttccctgcacaagcactttctttgccttctgccatccatgtcttgctcctccttgccttccaccatggttgtgaggcctccccagccatgtggacctgtaagtccattaaacctcttttacttcccagtctcggttatgtctttatcagcagcaaggacacggactaatacagatggctcatccagaagttagaaaattagagatgcagacctggcaaagtagatctgaaatgggactccggaactaatgacantggctttctaggttggaaacacttacaaacccagacatgagactcacaccttaaatggtctgttggagcttttatcctggttttccacaaaaggactatgaagaatacaaatggctccttcagagagtggcagttagcagctctttattatgagcgctctcttcgtcctatttaggtaaactccattcta

SEQ ID NO: 187 - DNA, 3001 bp, Homo Sapiens
  allele 1501: 99-26138-193 : polymorphic base C or T
  misc_binding 1481..1500: 99-26138-193.mis1,
  misc_binding 1502..1520: 99-26138-193.mis2, complement
  primer_bind 1309..1327: upstream amplification primer
  primer_bind 1741..1761: downstream amplification primer, complement
  misc_binding 1489..1513: 99-26138-193  probe
  misc_feature 65..66,980: n=a, g, c or t
tcacgaggtcaggagattgagactatcctggctaacacggtgaaaccccatctctactaaaaatnnacaaaaaaaaaaaaaaaaaaaaaaattagccgggcgtggtggtgggcgcctgtagtcccagctactcgggatgctgaggcaggagaatggtgtgaacttgggaggcggagcttgcagtgagctgagatcacgccactacactccagcctgggcgacagagcgagactccgcctaaaaaaaatttgtttccctctttcctttctcatttcatgaatcttttatattctaggttatctgaaaataacaaatgaaagaattatataaaatcgatattttgtttccagaatttttctacatatttgttagttctgtctttgccttacttcacactatcagtttttctttaatatttggtgatccttagtgttcgctcatagttacagaatgaagattcgatttcaatgaagattgatttagatacgtagatacaaaaaaaggttttctctgaaattttgaccatgttcagcacattaatttgtcaagggacttggaagaaaagactatcaataaaatatatatatatatatatatatatatatatatatatatatatatatataaaatttgcaaataaaaaacatatcaaacattaaaaatcatgccttcaaatcatatctagaaaatcaaaaaataagggaattatagatattcataatctattcatgattagtaataattagaagaaaatcaatgataatattaaaataactaatatcaattgtttgcatatgatgtgccacttattttactaaaatattttaagggttgattcatttactttgcaaccaacttttgaggtaacatccttttcattctgttttcctgaggaggagattgaagaacataaaagtgatctaccctgcccaagcaacacaactactatacattgctgctggattatagcccggctccgnttttttttttttttttttttttttttttttttttttttagatagagtcttgctttgtccccaggctggagtgcagttgcgtgatctcggctcactacaacctctgcctcccgggttcgagcgattctcctgcctgagcctcccgagtagctgggattacaggcgtgcactaccatacccagctaatttttgcatttttagtagagacagggtttcactatattggccaggacggtctcgatctcttgacctcgtgatccgcccgccttggcctccaaaagtgctaggattagaggtataagccactgcgcccagccccagtcttaacagagagcccattttcttaactttgcatggcattttttgtctcagattcataaatgtgtgtgtgtgtgtgaatcatatgtcaaaatgttatctttggatggtgatattatgggtgacattttattatttgttattattattttattatttgtgctttcaaactatctgcagtatatgtttagtaattttataagyagaaaaatttctagtgactttacacaatctggattaaaaggcaaagtaatatgagaaggttaagaaatagggaaatgctcgaccggccaaggatgagcgcttctaagatggtcaaaagcaagtcttcactgggaacactgagcaggcaagctgcaagactagaaaataatgcctcatactgagatggttatgttgatataagacttttaacaagtcccagaatatgtctgtgaatgaaagtagcagtaaagaagtggtcaaggccatttgatatgccatcaataaatgcagagtcttgttcatatgtagatattaacgtcatgaagatgatggcagggatgggcataatgtggatcgggtttataaaagaggggcaccacctatgatgtgacagatgctggcacaggaagagaaattagagttcggtcaaatcacttatgtaatcctaaaaagatgagaatttcattttataggagagcgtggatgtataatagagtggtgggaaaacgatttggggtatttaggggatcagaaagaattaaaactacaaccttgcaaatgagttaaatgaccataagagtataaattaatctcatgcactggaaaatgaaataggcactctatttgctgagggatgctaatgctaccaggactgtgtaaggttcaaatatcctaaatataatactggaacacagatattattcaattcaacatgtgtgaactgcaacttgtaatattctacaccataattatggtgtagaataaataatgatgaaatcagaatataaatctagttttccatgaattcttagtgagaatatgggattcatggaaaaaatttaatgttctttccattgtgatagattgtactgtgtactgaggaactttcaggtaaaggatgaaacattatcaaagcaaaattgaaagatcagagaaacactatagtcaactgcataaattaaaacttaaaaacaaaactagagtgagaagaaacttagacgctaacttgaagatctcctctgtttcagcttgttcctgaagggtctggtttcatgtgaacaaattttaagaccgatgcattatggtaaactcagttagttagaaccatgatattagagaggacagtgacaatgtcagcatcccatatcagtcaacatactgaaagggggccaggtgggcatggcaacatacaaaaacacaagccaaaggtgcccagcttgatctttgatttgtggttttatatgttggcatgcttcttgggtttgtgcctctcctcccgtgatgtttccttggggcaggctgtccgcatgtgcagtggcctgccagcccttgtgagggaccacatgcagtgtgttccctgaagttgttcacgtgcgcatttgagccgtttttcccttaccagttgagtggtcctagaagaaggttatatggcagttaaactctgccattttgtctcttagtgtgcatgcttgagccccgcgcccaacttctgagatctta

SEQ ID NO: 188 - DNA, 3001 bp, Homo Sapiens
  allele 1501: 99-26146-264 : polymorphic base C or A
  misc_binding 1502..1521: 99-26146-264.mis1,  complement
  misc_binding 1482..1500: 99-26146-264.mis2
  primer_bind 1746..1764: upstream amplification primer, complement
  primer_bind 1314..1334: downstream amplification primer
  misc_binding 1489..1513: 99-26146-264  probe
aatttcaatactatactctcaatattttaatcttccatttacctttttctttctttggaaaccttacttttattaaagattataataaaacaaaacacagagagtggctgattgggcatggagtggccttatgttttgaaataattacacgtggagccttctctggctttcagaatttcttctggttttgacagtaaagcatgtgccgatctagttaagtatatgtgatgcactcatggtgtgaccggcaaaggtatagctgtacattctggaggagaaaattgttgtaggaatgattatttcatgctgctcttcacctatgttggctcagcaggtatccacacaaatgaagttaggtaccaatgatcaagaggttctacatgagaaacgtggtatataaatgtatctatataccattttgttatgaataattaatctgctgatatcagaattggtaaagtcctcatagcatttcagttgtagctatttttattcatggtttggaagactgcatatagttatatagctttatttcatacatcctcattagtagcatctatgcaaagaactatttttacaacattttaataaagaaaaaaaggagctggatcaggaggagtgagtaaatctgggtttgaatcagaattctgctccttattggacaggatatctttggcaagccacttgaactcagtctcaggtttctcaactaaaaatggctatattataaatatataggcacttaccactaatttcctaagtagttagataatggaagcaatttgcaaccataaatgtaagatatgaaaatactttatacttacttaacaccttactctgctttagcatgttcatgtatgtgttgtcatttgattacacaaatttttagactaagcaggaagaaacttttgctccaaagttacttatttaaaaaaagtaagaaataagagaagttacaaaatagttaaaaaggtccgaagtgaataaaatattaatttgtgtgtttgttgaatgcctaaaacaaatccaaatctatgggggcgttcacatgtacaaattaattttaatgaacactgtgaaatcactattataggtaaaatgttagtgataaatataaatttattaatcatttcaaaattctcctttaaaatgagtgaactgagtcatagagaaatatagcaacttgttttctaatataaaagtgaatgcctgtgaactaatatttactgagtttttgactattttttaagtcctacattcaagcgaattctttattaatctacataattaacctcagaatatcactatattttcctatttttcatgcaagaaactacagatggtccccaacttaagatagttcaatttgggatttttttgatattaaaataggtttactaaggtactaaatgcatttcaacttacaatagtttgaatttatgatgtgtaattataaggaagtaatcccatcttaaggtgataagcatctgtagatgtaaamgatattaaataatgtagccaagataatgcctttataagtgaagttgatttcaaaacctgctttttggctcagatttgtttcataacacatcactgcattagttgtgtcataataaaaatacacatactagtaacaaatcccaaataacaacttcggtctgaataagtcgagtattcatttcctcttaattgattcacttaaactcatttcctgggtagatattaaaatgtatgaaggatttttaggttttgatgggtgtaaaactgatgaaactcataaacacgtatattataaatactctaatatagataaacatagagtgagaaaagagaagcatatactgagtgctagtcaagagacaaaatctcgattcatttataagtgaatagtgaggacttcaaggaaatatgctatatacattgcctttatattcccagcaaatggataaacatagaaagagtgatctgaaagtaatgtgtattcagagacgctatggctaaccaataagtcacagataacggacgcaatgtcaagaaatgagcttggaagacgcagcacactgtgaagggcattgagtgtgatgctgaagtatttaggtttaattctggaatcaatgaggagttatcgaaggcatgggagagacgttcaagcaggaaaatggcatcatttcattattagaaaaaattacaaattgaattaaagctataaggaagttatatcaaatatggaaagtctaatagttttcaatgccaagattcattacaagactatgtaaagaaaattctgtgctttttttttttttttgagacggagtctctctctgttccccaggctggagggcagtggcgccatctgggctcactgcaagctccgcctcctgggttcacgccattctcctgcctcagcctcccgagtagctgggactacaggcgcccgccaccgcgcccgactaaatttttttttgtgtttttagtagagacggggtttcaccatgttaaccaggatggtctcgctctcctgacctagtgatccgccggcctcggcctcccaaagtgctgggattacaggcgtgagccaccacgcctggccagattctgtatttttatgttctgattaatatttacaaagtgaaaactcatttattttgtaaggtattgatgatcttctttctttatccataaattatatctttaggtattgtgagaagcaaatcaatattatccaaagcttattgtgccaacattttttagtgaagaggtacagtacgtttttatttatactgaaacacattaaaatatgaaataacatctttaaacattttttacttatatgtacatatatttatgagttatcaaattttctaagaaaaggaatttatcattttgtagaaaggcttgctcatttttcaattgtgttctaggttaaaaaaaaaagaaagaagagaaagtgtgtatctaaggtctatcttaatatttggtcatttttatactgtagtttctt

SEQ ID NO: 189 - DNA, 3001 bp, Homo Sapiens
  allele 1501: 99-26189-164 : polymorphic base C or A
  misc_binding 1502..1521: 99-26189-164.mis1,  complement
  misc_binding 1482..1500: 99-26189-164.mis2
  primer_bind 1644..1664: upstream amplification primer, complement
  primer_bind 1215..1235: downstream amplification primer
  misc_binding 1489..1513: 99-26189-164  probe
tagcagaattaaatacaagctctcacatcaaatctctcaggatcaatataattacttgatctaattgttttaagatgaagactattatattgtttgtttttctctgaatgtttttgtctttcccaaaataccgattatgactttcattaatttttcttcatcatggatctgatattatttgaaaacaaatgtgtccaaaatcctttaaaatacagttgaagtgacattggttgcaaatgcatgctagtccacaaactcagttactgcaaacaaaatgcacattaatttttttttttagattaactaggcaccccagcacaaaaccttgtaaccatgcccttcaccttcatatcaaaggcctatctcactctgacatgttctggccagtggatgcagggagatgggaagagcactgtatcaaatggggctggcctgcacttgttccttttccttcccatgagagaaggccaggacaaagcccctgaaggataaaacatatggagcagtgttaagttgcctcagttgtcacaatccatcccagacacaaagccagctgagtgacctcaccaaaaccagagatctacttaaccaagcccagcctaaatcactgatgtgtagacccgtgaaccaaataaatgaggattattaaagtcaatgtgttctgtgatagcttctatacagcattataatgacactagataactaatacaaaaatacacaaagcatattttatgcatgtttaaagtaaaataaattttttaaaaaaactgcagtgactgtggaaatcaaaacaaaaacataccttattctgtttggaaattaaccaaactttttcatcattatagaaagtcacatcaacaatggcaatgttatccattattttaaagtgacagatgcaatctgtctgcatcattctatattcaggatgccatatacatcattttaccggtaagcgtgcatgtgcaataatatatatgcagtcaatcttcattctttgcagattgcatatctgtgagtttttcttactaaagtttatttttatcccccaaatgaatactcacagtgctttcatagtcattcacagatatgcttagagtgatagaaaatttgaatttttaagaagcatgtttgaatgaggctgagttgaacaaggcaatgtcttctctccttgttacagctttcatgctgtaaacacttgttctcctcatggtctagtgagtggcactttttttcagctttgtgtttttgtgagtaattttactgtttaaagtggcccccaaatgtaacactaaagtgttgtatagtattctcaatcacaagaaggctgtgatgtgccttatggggaaaaattcatatgttagagaagctttgttcacgtgtgagttatagatagtgttcttggccatccgatattggatttcagggttaattataaacaatctattaatagcatatccagaaaagtagaaaagaaatgtatcaatttgcctgtgaggctgcmccagaaagtgctaaagtgatccctggtgtgtgtaataatggtatggaaaaggtggacaaaggaccaaatttatggattcatgagatgataactgacttttaaagatgcatttggcagcatcattatgaagctggaggccaaaggagcttatggttacatgacccagcatcagaaaaatgtgaaaccctgttcccagctagcactggctcacacacttcatagggtgatacagcatgaacactttcagcttgcaggcaggcaaggtagtctctccagatcaggaggcagtggaagcatttttcaaatccctaataactgttatgtgaaagagcaggttttcaacactgatgagactggcttgttttacaaggatgttgggaaacaaacctgtatgaaacaaatgcatttcagttaatgaaaatgttgtggccagaggcttgcaggaccctaactctgtacttctcctaggagcaataattcagtattcactaattcagtattctcagaaactctatagaaaatacctaccatgaacaaggaagactgcgtgtgctggggggcgggggtggcaggtgtgtttgtgtgtgggtgttaaatattgtttcacttctcatacccatcttattcattatgagcaactgtaaaactttatcaacttcattacggctattagggttatcatgcctgaacattaaacatatgaatatgtatgcatatatagacacttttaacatgaattactcttcttttttattttacagtaagtatacaattttactaatttttagaaattacatgtgaagtagctatattaaatgtaagttttattgcagaattgtaaagggaaccctatacaaaacaatttagttctcctaagattaaacaccactaaggtagatcactcatgtagaaaaggaaggctagattctgtttaaatttttaaaagaatataaaattgattttactgagagaattagagaagtagagaaaaatttaaaaatcatgggtcaactgttgatcatttggaaattgcaagtttagatatcaaatgcatatcttacatcaaaatgaagtcctcatgaaatagatacacatgtgaaatctgaaataataaaataagaagggattttaaatatgtgttttggaaagacaaaattacctgagaaactgtaaagacaaacaataattatacaaaaattgtaacactttgtgtaaaaaattacataaaactgaaagataaaatgggaagtgataggatttttgctgattaaattgataaagactaggttgagtgttgaggacaagtatcagtaactctgtaagagatgtgtggtcatatgatggtacatttttataacttttccgaaaaagcagttggtcatgtatcatacctcaaaatccctaaaattcttgacctagtgattttacatttaggcatgtatcaaaagtatacaaacatatatacataagtacataaatgtatgcatatatatacacata

SEQ ID NO: 190 - DNA, 2997 bp, Homo Sapiens
  allele 1501: 99-26190-20 : polymorphic base C or A
  misc_binding 1502..1521: 99-26190-20.mis1,  complement
  misc_binding 1482..1500: 99-26190-20.mis2
  primer_bind 1502..1520: upstream amplification primer, complement
  primer_bind 1071..1091: downstream amplification primer
  misc_binding 1489..1513: 99-26190-20  probe
gaagatacttgttacacattgggaagcagtacagtgttgcccttctgagccagggcctgtgataagtctgtgtttaaatgccagctttaacccttgccagctgagctccccagtgtttgttacttagcatcccctgttcagaggcagccactgcatctacctaagtctgtgctgcaacaagacctccaaagtccaaagtactgcagaaagcttttaatttgcgtcatttattcccaggtcattcgtagtggccctctatcatgcttacctagactctcaaaaacccaagtcacaaatcactgtatatgtcatctgttggaaaattctgaatcccccatctccctcctccaggcaaaagttattttggcttcacatctcgtctgtataacaaaagcttgtcataaaacgtatgttctactgcctattctaggtgacccacaaacagttatttaaaatttaattattcatcctttcccttcttatgtcttcaggggaatgataaaaatattcaggcaaagatctgtggataggtgaggtgtcacctttaaccagggtagcagaattaaatacaagctctcacatcaaatctctcaggatcaatataattacttgatctaattgttttaagatgaagactattatattgtttgtttttctctgaatgtttttgtctttcccaaaataccgattatgactttcattaatttttcttcatcatggatctgatattatttgaaaacaaatgtgtccaaaatcctttaaaatacagttgaagtgacattggttgcaaatgcatgctagtccacaaactcagttactgcaaacaaaatgcacattaatttttttttttagattaactaggcaccccagcacaaaaccttgtaaccatgcccttcaccttcatatcaaaggcctatctcactctgacatgttctggccagtggatgcagggagatgggaagagcactgtatcaaatggggctggcctgcacttgttccttttccttcccatgagagaaggccaggacaaagcccctgaaggataaaacatatggagcagtgttaagttgcctcagttgtcacaatccatcccagacacaaagccagctgagtgacctcaccaaaaccagagatctacttaaccaagcccagcctaaatcactgatgtgtagacccgtgaaccaaataaatgaggattattaaagtcaatgtgttctgtgatagcttctatacagcattataatgacactagataactaatacaaaaatacacaaagcatattttatgcatgtttaaagtaaaataaattttttaaaaaaactgcagtgactgtggaaatcaaaacaaaaacataccttattctgtttggaaattaaccaaactttttcatcattatagaaagtcacatcaacaatggcaatgttatccattattttaaagtgacagatgcaatctgtctgcatcattctatattcaggatgccatatacatcattttacmggtaagcgtgcatgtgcaataatatatatgcagtcaatcttcattctttgcagattgcatatctgtgagtttttcttactaaagtttatttttatcccccaaatgaatactcacagtgctttcatagtcattcacagatatgcttagagtgatagaaaatttgaatttttaagaagcatgtttgaatgaggctgagttgaacaaggcaatgtcttctctccttgttacagctttcatgctgtaaacacttgttctcctcatggtctagtgagtggcactttttttcagctttgtgtttttgtgagtaattttactgtttaaagtggcccccaaatgtaacactaaagtgttgtatagtattctcaatcacaagaaggctgtgatgtgccttatggggaaaaattcatatgttagagaagctttgttcacgtgtgagttatagatagtgttcttggccatccgatattggatttcagggttaattataaacaatctattaatagcatatccagaaaagtagaaaagaaatgtatcaatttgcctgtgaggctgcaccagaaagtgctaaagtgatccctggtgtgtgtaataatggtatggaaaaggtggacaaaggaccaaatttatggattcatgagatgataactgacttttaaagatgcatttggcagcatcattatgaagctggaggccaaaggagcttatggttacatgacccagcatcagaaaaatgtgaaaccctgttcccagctagcactggctcacacacttcatagggtgatacagcatgaacactttcagcttgcaggcaggcaaggtagtctctccagatcaggaggcagtggaagcatttttcaaatccctaataactgttatgtgaaagagcaggttttcaacactgatgagactggcttgttttacaaggatgttgggaaacaaacctgtatgaaacaaatgcatttcagttaatgaaaatgttgtggccagaggcttgcaggaccctaactctgtacttctcctaggagcaataattcagtattcactaattcagtattctcagaaactctatagaaaatacctaccatgaacaaggaagactgcgtgtgctggggggcgggggtggcaggtgtgtttgtgtgtgggtgttaaatattgtttcacttctcatacccatcttattcattatgagcaactgtaaaactttatcaacttcattacggctattagggttatcatgcctgaacattaaacatatgaatatgtatgcatatatagacacttttaacatgaattactcttcttttttattttacagtaagtatacaattttactaatttttagaaattacatgtgaagtagctatattaaatgtaagttttattgcagaattgtaaagggaaccctatacaaaacaatttagttctcctaagattaaacaccactaaggtagatcactcatgtagaaaaggaaggctagattctgtttaaattttta

SEQ ID NO: 191 - DNA, 3001 bp, Homo Sapiens
  allele 1501: 99-26191-58 : polymorphic base G or A
  misc_binding 1502..1520: 99-26191-58.mis1, complement
  misc_binding 1481..1500: 99-26191-58.mis2,
  primer_bind 1539..1558: upstream amplification primer, complement
  primer_bind 1095..1115: downstream amplification primer
  misc_binding 1489..1513: 99-26191-58  probe
tcagctctgtcttgcagtctgcacataggtcgcatagcctaagtgtcataactgaatgtatcacatttgaacagccggccattaggcagtgcattacacaaagccgttccagtaaaagctctgagaatggctcgatcttggagaggccagacctatgcaaacagagcccttgagatccattttcttgaacttcctttgtttgtattctctgatgtttgcagatgctatgtgtgtcttttgattgattctatttggttgcttcaatgagtacacccagtgggctttgttccctgtgagttaaaatagcaaatgaccatgatgaaatatttccacctgcacataaagatcttatcatatgttacagccagcttcatcacgtttaaaactggtggattttctgagagtcgttaactattaacaaaacgttctttaaaatcctctacaaagttcacagatataaaatatctctcatcagatagctataaatatcatttgccccatcagaaaaagcaatcttccatctcttgcgttcaatcatctagatgcatcaaatataaatgttttcaattaacgagtttctgaataattgcctcatgtctacatgtattttttatgttgttgaatggtccatgtggtatatgacacatttctaaaaactgacctggctattgctaacttttaaattttaaatgtagacttaaacaatttgaacaacaatgggtatgtgtatctgcttattccaagaggagatttctctgtgattcaaattatgctgggtaagaacagagttcagagtttcatttcattgattttatttgctatgaccattctcctccaccctttttgcccagttctatcaagttcttcattgcactgcttcttgatctaaaaccacttaagaattttagctttttttctcccattgagacattttctaaagtctgatgattaaactttcctccatttggttcccaataacttccctaaatatcattataactttttttcctgtagaagtttatttcataagttctctttttagtggtagttgaatgaacaggcacaatgacatccgaaatgtcctaatttacaagatgtgttgtgatattggctggaaaaaaaatgccaagcatgcagcacctacacagatactacaccaaagagaaaactgagtaagttcatacgtttgtgcaaaacaaaattatacggataaaatataaatgaccaaagcaactgatttgccattttgtacttgctaaattagcaaaaatataaaatatatataggtttcaaacccaagactcccacgtactgttggttgaaattaaaatgaggagagagactttttagaaatgaatttgattaaactttcaaaaagtctcagaattgttcaaatcttttgacccacttacttcatttctgggaattatataaataatctcaagtattacaatactgataggcatgacaaccttcattgcaaagtgattgatagaagctrtattagaaacaaaacttaatacaagtatccaaaatgtccataatgagaagatacttgttacacattgggaagcagtacagtgttgcccttctgagccagggcctgtgataagtctgtgtttaaatgccagctttaacccttgccagctgagctccccagtgtttgttacttagcatcccctgttcagaggcagccactgcatctacctaagtctgtgctgcaacaagacctccaaagtccaaagtactgcagaaagcttttaatttgcgtcatttattcccaggtcattcgtagtggccctctatcatgcttacctagactctcaaaaacccaagtcacaaatcactgtatatgtcatctgttggaaaattctgaatcccccatctccctcctccaggcaaaagttattttggcttcacatctcgtctgtataacaaaagcttgtcataaaacgtatgttctactgcctattctaggtgacccacaaacagttatttaaaatttaattattcatcctttcccttcttatgtcttcaggggaatgataaaaatattcaggcaaagatctgtggataggtgaggtgtcacctttaaccagggtagcagaattaaatacaagctctcacatcaaatctctcaggatcaatataattacttgatctaattgttttaagatgaagactattatattgtttgtttttctctgaatgtttttgtctttcccaaaataccgattatgactttcattaatttttcttcatcatggatctgatattatttgaaaacaaatgtgtccaaaatcctttaaaatacagttgaagtgacattggttgcaaatgcatgctagtccacaaactcagttactgcaaacaaaatgcacattaatttttttttttagattaactaggcaccccagcacaaaaccttgtaaccatgcccttcaccttcatatcaaaggcctatctcactctgacatgttctggccagtggatgcagggagatgggaagagcactgtatcaaatggggctggcctgcacttgttccttttccttcccatgagagaaggccaggacaaagcccctgaaggataaaacatatggagcagtgttaagttgcctcagttgtcacaatccatcccagacacaaagccagctgagtgacctcaccaaaaccagagatctacttaaccaagcccagcctaaatcactgatgtgtagacccgtgaaccaaataaatgaggattattaaagtcaatgtgttctgtgatagcttctatacagcattataatgacactagataactaatacaaaaatacacaaagcatattttatgcatgtttaaagtaaaataaattttttaaaaaaactgcagtgactgtggaaatcaaaacaaaaacataccttattctgtttggaaattaaccaaactttttcatcattatagaaagtcacatcaacaatggcaatgttatccattattttaaagtgacagatgcaat

SEQ ID NO: 192 - DNA, 3001 bp, Homo Sapiens
  allele 1501: 99-26201-267 : polymorphic base C or G
  misc_binding 1502..1520: 99-26201-267.mis1, complement
  misc_binding 1481..1500: 99-26201-267.mis2,
  primer_bind 1749..1767: upstream amplification primer, complement
  primer_bind 1304..1324: downstream amplification primer
  misc_binding 1489..1513: 99-26201-267  probe
tttcaaaattggggaggcatgtttcaaaattggggaggctgaattaaaagaactgggctaacatttgataggacaatcaactgtgcaattttatgaactgagaaagtgtactgacacaagaaaatgttatgaaaacagcagagttaggaagggcataagttctttttatactcagaatctatgattttatggattccaaagaggaaagctgaatgcatagtggagcagtattagggttctccagagaaaaagaaccagtagcattaatggatagatagatacagtatatatataaaatatatatgtgtatatatattatatatacgtatacaatacatagtatatataatatatagtatatatagtatatacatactatatataatacactatatattactatatatagtatatattatatatagtatatataatatatagtgttatatatatgatatatactatatatatcatatatagtgcacacacacacacacaaacggagagaggttattttaaggaattggtttatgtggttgtgtggctggcaagtctaaaatttgcgaagtagaccagcaggatggcaatccaggggagattaggtgttgctgtgtgagttcaagggcagtctggaggcagaattccctcttccttgggggatgtcagtctttcgccttaggacttcagctgattggatgaagcccattcatgctttggaggataaactgtttatttaaagtctactgatttaagtgttaatctcggggaaaaaaaaaaggtttactgcaacattcagttgtgtttatccaaatatttgtatatggtggcctagccaagttgacacagaaaactagccaccacgggcactgtattggaaaacttgagagaaaacagtagtcacagtttttgcttttaaagatgagtatgaacagtagatggaaggagaatcagccaagtaagccttttgcaatagaaagatacaaactccaataaaacacctgaagtaacataaaaataaggcaaatgcccaaaagataaaaatggaaaagaagctacaaaaagagtatttggttggcattctctgactattctcaggatatttgaagaatcaaaggttctggaataaggaatagagaaaaaaatctttaatcgaaaagggagactgaactggtcactagattttatggtgtaaaataatattctagtctctagaaggaaaatctgccaactagacagggagaaggcaagggaatttgtctgttctgctctagacagtagtgaaaatgacataaaataaagtaactctctcaaaaaatgtatgaccagagacttacctttggaacagtaattcacatcatctgagtagttcaggaagttttacatagagaaattagcataaaatgtataacatatgatatccctgacataaattaacacagcatctctccagcgataggtcctcagtacagggtagagagaaatctcaaggataaaaactcasaaagcataagcctccatccaatactacaaatacatgagggggaaatacccactctcagagaaaatcagtgaaaaataaaaataaagtttggccctcattaaaattagaaaaggagggttttttaaaatattaaatataaaagtaagtgtgcctaaaataaatcaatatataaatgttggaataaaaatatgttattaataaaaaatataagacaatgtagacaaacacttaataagataatagtaaagccactaagagaaattctgggaggcaaaaaaaaaaatattctcacatattaagacaataaaacttgttaagtcagaaaatgtttgtgaaggtatattgtttaggagcaaaacagaaattttaaccaccttctctaactataatgatattattacaagcagtaagatataactaaatatatcttatataattgaaattttaaatacataccatgatgggtcaatgaagatattttaatacatatttatttaaaaatattttgtattgaacaaaaattatattgaaaagtttagtttagttattcatataaggtgctacagagatcaaaatttctaggaaaaatgcttataatccaaaggaagaaatgaacttatgttttaggttaagaagttctcacagagaacagattcactaaaaaaaggtagacagaaagaaataataaagatgtgtcaaaattaataatattaatataaataaaattgaaaaatacagacggtcccttgaccattgaagaaatgaaaacttaactgaaaaaggtacacataagattcatcacactcatgtctcattttatgggctaaaagtttcttcattccaaaatctgacaaggacagaacaagaaagaaaaattatactcctatctcattaagagtcactagccctatatataatattatcaagccaatcttgaattatatgttagaaaacatatgattaggctgaattaaatcactggagagtgaggatggctgacccttagaaatccatgaaagtaacctaccacattaagtaattcacataagaaaataaaagattatctttaaaatgctgctatggtctgaaagtttgtaatcccttgaaattcatattttgaaatcctaacctacaaggtgatggtgtaaggaggtggaagatttgggaggtgattagttcataaggatagagccctcatgatgggcatagtacccttataaaagaggtcccagagatcttcctcacatctcccaccagagtgcacacagcaaaatggcaccatttgtgaaccaggaaatgggccctcaccaggcacaatgcagcttgatcttgaactttccaggctccaaaactgtgagaaacaaatttctgctgttaataagccaagcaggttatggtattttgttatagcagcttgaacagactaagacagatgcaaaaaaagatctgatgaaatgtcctcactcattcacataaaaaaaactactttcagaaaataag

SEQ ID NO: 193 - DNA, 3001 bp, Homo Sapiens
  allele 1501: 99-26222-149 : polymorphic base A or G
  misc_binding 1481..1500: 99-26222-149.mis1,
  misc_binding 1502..1520: 99-26222-149.mis2, complement
  primer_bind 1354..1373: upstream amplification primer
  primer_bind 1843..1863: downstream amplification primer, complement
  misc_binding 1489..1513: 99-26222-149  probe
  misc_feature 2564: n=a, g, c or t
cttctaggcttcagactctgcccaaagtacaagtcttagacagaccaagttaccctttagcatctgagttgtcctatcagtaaagtgaggacaactgtatttctcaagaaggatctggtttcaatggacaacaagcccaattcaaacttgcacaagaacaggggaattcattgtgtcttgtgaaataatgttcaagagaatacctggagaaacttgacccaggaactttccttgtcagcagggactggcatttctccatctcagctctgttcacatctatgtgagccccaccttaatgtagtgatatttatggagcagacctctggatctccaggatgacatcctcaccctcaagcccaatagaaaaggaagagacattgttctctaagtgtatcaatacaagttttggggtggatcccattggcgtaaatgggattagttacacatccctgcaccaatccccttggctggtagactggggtttacagattgacttaaactatagccaccttcaacaatatggttgagttactctttattacataaagagtgaactaaggaactatctactttaaaaaaaaaatagggcattaccatgaaacaaatgaggaacaaatacttgacaataaagttgcaaatgtccggtatcagaaaataaaaactgcctattaagtcagaacctcatatattctgtcatactctcttggcttaccctctccccacctttttttttccctctagccattgctggctggggcaaccaggatgcaaaggcactgtctgacagctcttgcctcagttcagggactgcagtagataagctatgtgtcattccaatcctgcttaggagaagaatcactgcccatgtgcaagagctgtagttagctggcagactccatctgctaattctttccaggtccacttcagccttttggccagtcactttttaatttaattttatttatttattattttttttgagatggagtcttgttctgtcacccaggctggagtgcagtggcacgatctcggctcactgcaacctccacttcccaggctcaagcaattctcctgcctcagcctcccaagtagctggaactacaggcgtgcggcagcatcacgtccagttaatttttttgtatttttagtagagatggggtttcaccatgttggccaggatggtctcgatctcttgaccacgtgatccacccgcctcagctctcaaagtgttgggattacaggcatgagccactgcgccctggccagtcacatttttagccttgtgtcctgctcaatgattgggcaaggtagtgctgtccaggtcacttttttttgagtcgttaatagcaagatggtaacgtaacaacctagtcatttctgccctaatgagcacgctggctcagaagtccagggactcctcagtctgacagcctgtcttggctaacttccatttcccttcttttaccccatttatgttattccttaacaaatccttcacatrcacaatgccctccccgtgtctgtttcccaaacagctcaccttgaacagagattttctgctccatattggaagatatacaagagcccacccaatcatttcagtaagtgcacacccggaaatgcaagagagtcaacaatggctgtggtcagtgatggatggaagttgttaaaggcattctttcctgctttgtgtctccgatggacaacttggaggtgtattccacatgggttctcaaagggttcacagtttgatatttagttgcacaaaaaataatcagcctactctttctggtacttcaacttctgtttccagtgaaagcatgcagatgctagtctctagctcagctcttggaggagatccaaattaaaattctggctgatccagttacatagtttgtggggccaatggcaaaataaaatgcaggttcccttgctcaaaaaaaattcataatttaaagacagcaacagcatgccattaaaccaaaaagcccttctagtgcccaagcacaggtcaccccctgtgaagctagccccaaacaacatataaggtaatatgaatacattgaggcatatagacttttgatctgtattttctctcgatgtctacataccatgtcattgctcaggaagcagtaaactggggaaatactgacctacccttataggattataagcatattataaatgtgcttcatagggaatctatcttcaaagtaaatttaagctgtgaatgtgattagtttagttttattaaaatatattggaatattggactatgtacaatatttaccttttcactttttgtgtagtaaggtaaggggaatacttttaggacaaatgcttccgctctttttgtgagcctactatgtgacacttctttgtagctgaaacactgcaagaagctgaggagttctgtctagtcatgttttattttgcctttggaaattgggaggctggttggagcagggttgcgggcaatagagaaggggaggttagcagaaaggtaaactctagatggctgctatgaagccgaggaaagggaacaagtcagcaatgaagctgantcctgactctgaggatccagctaggtgggagcacatgtaatttgaaacacttggcatacttaagctggatttaatgcctttgcttgtgtggttgtttgcttgcttgtcattgctcaacttctatgttgataagcagagaatatggatgcttccacacattcatgtatttgatctactttggaaggtacagtgaaataacacaaatttaggatgattttatgaggcatctagggtatatcaatgagatatctgccctcttatgtttgttgcagcactgtttacaatagctaagatttggaagcaacctaagtgtccatcatcagataatggataaagaaaatatgattcatatacacaatggagtagtattcagccataaaaaagaatgagattcagtcatttgcaacatggttggaactggagagcattatgttaag

SEQ ID NO: 194 - DNA, 3001 bp, Homo Sapiens
  allele 1501: 99-26223-225 : polymorphic base G or T
  misc_binding 1481..1500: 99-26223-225.mis1,
  misc_binding 1502..1520: 99-26223-225.mis2, complement
  primer_bind 1277..1297: upstream amplification primer
  primer_bind 1842..1862: downstream amplification primer, complement
  misc_binding 1489..1513: 99-26223-225  probe
cacatttttgtagcatcttttctgtgtgtatgtgtgtgtgtgtgtgcgcgcgtgagtgtgcatgtgtgtgtgtgtacacgcgtgtttaatttctattcatgggaattatcaatttcttttactatatctctggcttggtcccacatatttcaatctttagctgttatgtaaataagatactacaataagtattcaaattaaaatgtagcatatgggtaaacaggtgtaatattttaacagagtttgagaatttagaaaaatattttacagagccatcccctgcatattgtataatttaccctgaaaaatatagaaattagtagagtggtacttgctaattttctctttgaagatgtataaagctggcattttccccttctgttcccagaaattattgaaaagcaacaaggagaactacaaccaaaataccaggttttattttttgaatgaaactaggagaaaattagagcctccatctaagaacaagtgcgtaatattccagaatgagtgaagagtccagagaaccttgtggaaggtatcagagatgtcttcagagaaagactcaaatagtagtcatcaaaaaagatccagtcaaatacaaatctgaagtgcaaaatccaaaccatgtatttacaacagagagaaaggactagatgaactgatggcaacagccgttaaaatcctgtttagtttcagaaagagactttgcatatccaattaggaattacagagaaaaattcatattcacgaatatattctatctctatggagggggagaaatgttttgcattgaaaataacaacagaaattgtaaaataaaaacgattcatacagatgtcactctcacttggttagaaaaaagcaaagaaatgcaaatttactcctaaactttgaaccataaaaacattccaggcaatcaagaacacttccctgcctctacttccagagacagaaggagagacagagagagagagtgagagacagaaatgtgaggagaagaaacatgtagatacacctaatcctgcaaaaactcacctgcataaagttaagaaaacaaaacaaggaaattacctattaatcattaatctgaacttaactgcctttggattccaagcacaatacagtagctgattggagcctaatgttctactccaataagagactgggacatctgcctaaaaaaactggaaaagatagaatagacaatgatatacagtctttgaaatgcagcaaaaaacttcatagacaagggaagtagaggagctaagaatctggagaggtgaagaatgttgttaagaatctggagaggcgaagaatgttgttcaggttagtgacctgcagaacttttcccagggacggttttatcatgggagagaggatgcagtggagaatcagagcttacagccatttagaaaagcaaacgaacaaacaacaacaataagcaaaacaaaacaaaaaacaaacaacaacaacaaaaaacagaactttgccagagacctgkgggcttccaacacctggccggtttaactctgggacactgaccaaaccccagaaggacagtttggtgttgtacaccctgccctatgggcaggtactaaccaaaaaagcagaaagcttttgaaacactgactggagattttctgcactctggggaggcaatggttggaagtgcctgaggtaagaggcctgcagaatatgtaagattctctcagataaaagtcctggagggttagggacaaaccacaggtagatagtatgagatcaacctcactccacatacccctccaaaagaaagtgaaaaaaggaagttaaaagttgcataatcttggtgaaaggctttacacaactttcacacacgtcgatattacaaaaaacatatacatgtggtaattgtttctctgtttctgcattaatttgattagaataatggcctctcgctgcatccatgtttcagcaaaggacatgatttcatgctttttatggcggcatagtactccatgatgtatgtgtgccactttttctttaattcactgttaatgggcacctagctctcactgagtggaagttaaacattgagtatacatgtgcatcagatagcaccagcagacactatgaactactagaggagggaaggagacagggggtcatgatctgaaaaactatctattggctactatgctcactgcctggatgacaggatcatccatatgccaaaccttagcatcatgcaatacatctatgtaataaacctgcaaatgtaccccctgaatctaaaataaaagtagaaaatttttaacaaagttaagcattatgaatatatgtaaagacttgaggccgggcatggtggctcatgcctgtaatcccagcactttgggaggctgaggcgggtggatcactcaaggacaggagttcaagaccagccttgccaaaaagacaaaatcccaactctactaaaacctacatgctgtcgtcatggtgcatgcctgtaatcccatctactcaggaggctgaggcagaagaatcacttgaaccgaggaagtggaggtttcagtgagccgaggtcatgccactgcactccagcatgggtgacagagtgagactccgtcaaaacaaaaacaaaaacaaacaaacaaacaaaagactttatatatatatatatataaaatatataaggatagatagaaaaaatagaaataaaatctgtcagaaaggaaaaattttattatagacactttagtcattaaaatgataaaaaatattatgaataattttatgctaaaaagtgacaatttgaacttgaccaatttctcaaaatataactttcatttaaaatgtcacaaaaacaaacagagagtatgatgacttctaaatgtactttaaaattttaaaccaaaaagccagttgcacaaaaacagaccctgtatgacttgatttatatgaacgatttgaaatagtgaaactcatggaaatagaatgtggaagggtagttgccagaggccgt

SEQ ID NO: 195 - DNA, 3001 bp, Homo Sapiens
  allele 1501: 99-26225-148 : polymorphic base G or T
  misc_binding 1481..1500: 99-26225-148.mis1,
  misc_binding 1502..1520: 99-26225-148.mis2, complement
  primer_bind 1355..1375: upstream amplification primer
  primer_bind 1805..1825: downstream amplification primer, complement
  misc_binding 1489..1513: 99-26225-148  probe
  misc_feature 37,514,2455: n=a, g, c or t
gagaatcaatatgagaataaacaatacctctaatccnttttgcaatcactctatcattttaggcttaaaatacagcataatttttttttctcatttattttcctccttaataaaatcttgatggctcaagcaatgtgttatataaccttggaaacagattttttttaaaaaagctatcctcagtctaacttctatctacaggcaaaatcatcactaactcttcctacagttttttactattcttcttttttttccaataaaataaactttagaagttcttttaatgtatgcttctatttcagatgttctgattagttacaatggcatttgccaacataatttgccaaattgaaaaacagatacctgatcacaagtgagatatttggtaatctaaatgttgagaatgggaaaactttgttattgcaaatatttcaaatatacatcggataaggtaaaggtaattgtaaacaacttacataatactaacatttctcaggagaaatgtgtgcatacncttttatcaggtatgaggtgtagagcaaagcattgatttatggatttaaaaagtttgtatatttcatgaattctactttttatcaaattacaagtgatggagtgatggattaaaaactgtttttatttattggcagtacaggtgtttatgcaacctaagtgttattttgttttattatgtgagtgtaatacacgaaaatatgggataggttttcaagataattagtattattgattatttcaaaatatgtaatatgattaacaatatctatagtatataagcccttcctcacaaacgtaaagaataagtatataattttatttgacattaaaaaaagaattttattggtttatctctgctgaaattcttggaattcttgtaaataaaatgtgcattttgccaattttttaaatctcaatttttgcttttttattgattattgattttagaaaacaacatagggttgtttgtgtcatagttgttgttgggaattattaattggatttaattaatctttgcctgctctattcagatataataaattctggagaatttaagttaacactaattttaaaatctttatttaccaataacatcttgctatgacatgactaaagagaaaatttgttggagacacagaatctccactacagccaattattgcctctaagattttaagtgtgaggtgtgtgtatgcatgcaaatgagctcatgtgagtgtacatgtttaggggaaggagcaagacaggaagagatacattttatgaaaacaaatctataggtttagtgggtatatggttcagcgagtttctatttttactgtaaattgtggaaaggaacctctaatatcaataaagcctcaaacatgtttgctgattctaggacatattgtcaatcacgcactcacaggagaattttccatctacctgaaataatttaaatttatcttatatttctctttgatgagaatcatacaaaatggaattkatctgaattcttgtgtttgcagagcacaacatatagcagaactattaaaaaaaatcaagtacatttgtaatagttgaaatacaaaagaagttggccaagatatccccaaatatgctaaaaagtcctctaattgtgatgctgaaagaaacttttctaaactatcaaaaatgaaatgcaaattgtagttagtagggctaaaaaaattactaaattacctttttcttatctctacaaaaaacattacaaataatattttgtcgtatgaagtgtgatcaaagtatatgtaactaaaaactaaggaatcatttatagtttatcaggcagtcaattaataaaaacatgctatttttctagattttgtaatttgaagtagtttccatcattaattatttattgtgcgttttctctttctgatcatgcttacccatttttattaatgaatttgtgtcaactttcttaaaaagaaccccaaaatgcataaacggcaaacatcgtatttctgatctgcacctgtatatgttctttgatattatctctttctctgtttctcttttattttttatttttggaagcagggaagaggttattttgatgatttcttttccaaaaatagaattgtgaaattataagattcatgtaactctaaaaaatttcagcttattacagtgaatctttttaaaaaataaaaaaaaaaattaaacaagcattgacatcattaaagatcattaaacaaaaaacccaataatacaaagtcacattggcatgcccaaaaaagaataaaatacagtttttggaaacacgataacaaagtaactgaaataaactaatttaaaacaataattgattaaatatcacaaaagataagttaaacgttatttcaaattaaggttttatgaaaagaagcaatgtcagtaataggcaataaatttctttttctttttttttttttttttngagacggagtctcgctttgtcgcccaggctggagtgcactggtgtgatctcgactcactgcaacctccacttgggttcaagggattctcctgtctcagcctcccaagtagctgggactacaggcaagtgccaccacgcccggctaattttttgtgtttttagtaaagacagggtttcaccgtgttagtcaggatggtctcgctctcctgtccttgtgattcgcccgcgtcgaactcccaaagtcctgggattacaggcatgagccaccacgcacagcttaggtaataaatttcaagtaaaattcaattcatcaaaaaattgcaaatacattttaaagtacatcttatcatgtaaggataaaaacataatcctagaaaagataccaacatttttacagtaaggcatatccatgtgtgtataatagcatacactatctttcgtaaaacctcacattaaatttaatataaccaaattctcatgcattttgaattttttattataaggtaaataatattcttgacttctctaatataaattcattaaatt

SEQ ID NO: 196 - DNA, 3001 bp, Homo Sapiens
  allele 1501: 99-26228-172 : polymorphic base G or C
  misc_binding 1482..1500: 99-26228-172.mis1
  misc_binding 1502..1521: 99-26228-172.mis2,  complement
  primer_bind 1330..1350: upstream amplification primer
  primer_bind 1792..1812: downstream amplification primer, complement
  misc_binding 1489..1513: 99-26228-172  probe
atcgttgttcataggcaggctcttttaagaacataaagatcaaccatcatggaaatttaataactattatactcaattgctgaaacacaccttttcctcccttgatctatagttagcattccttcaataattttttttaattcatggaattcaaaaacttcaatgatttttttctactgggctgtctaattttaacatggtaagtacttggtaaagttcaatacctttccccttataagtttttcttctaagcaagctaactgattttagaataggagatgttaacaccataaatacatttgtcaggattaggttttcacattgctttggggatattggaacactttcttaatcaccctttaggttttgtttgaggctctatttcaggattcacagaaaggccttggtttgtggttgaatgacatgacgaggcatttactgtcacaaatataatagcagttataagtaaattgatatccaggtaaaaaacagtgtatttttccaaatctgtcaacattatattttgttatgaagagaataacgaaaagaaatggaatctttgaaaaataacctttgatagataacttaatgtccttgagtttaaatttactctctttttaaaaagatgggagtatatacaatattactctaacgtttctttagacatcagaattggatgttggtttgagtaaagatattctatttgtgtgttttcctctctccttcttttctatataataaatgcctattttgctaatgtgtttaattacataaatggtttttctgattccgtttggcagaaagggttgatttcgataagtattttattattaatattattcataataatcaattttagctgattactttttatgtctaaacaattgttcaagtgtcaattaaggatccatagagcacagaatagacataatcatcattgtgtcatttggtgtataaacaattagatgaatctgatctctaaattcaacaagtgggaaagtattatatcaaataaactgcaaataaaaattacgtgacagatgtgatttatgcacaaaggatttgggagataacaaatttttaaaattgtctacaactgatgctatattccataaaaacatgttatttgtggtattttttaatctattatagatttttttctaacttttgttttgacattcaattttgaagctattcatttccactcaaaaatacaggccatccacctacagtgctaagttactatttagtacaatgccttataaacttgacatcttcttatactttctgaacttctatggttcagtggaaaaaagaagcattgcactaggttatttcagacattgttagtctgacataatataggaagtatttttgtgctacacttttatcctggcgtaaaatgtggcataatttttaggttcaagagctgttttactcctattcaaaactttcttccagtgacctaaccaaaatagtatgtattaaaagcatgtataasctactacttttctatgaacaatagccttacaatctgtttgccttgcataaaacacatacatatgtgcacacctatgcaccataagctgtggatcctttgtgtgaagaagacacctgtccaccatggagaagtcccacttcccaggttttacatctccaaccccagagttcaaagccagctattcttcaatgattggaatagtttgctaaaaattaaaagtgaaatacgcaattgcaaataaatatgaaatgttttgctttctttaaatgtgcaccttttaaattttatctcttggatgtattaacacactaatatgagttggcttttcaaagtatttattgtctaaaacatggtttctcaaactttcatgataacaaagttttatgaaaattttttagatttttaaatgaaacgttagatatccctgcaaatgtgctaacacttgaatgaaatgaacccaggtttgcattttggttctaaattttagttgcaagcaatttacttaacgtcgttaatcactagtcttttcctaaggaaaggggaactgatagactttatctttttcagccgatgtagacattaaattaattaatacatgtaaattgtttaacatagtttcttccacagagtaattgattagtacaataagaaattattattattaatctagcttatttttattacatttgaaacaacaatatctgaaagacttgcccatatcttttcaggattcagtcattgcaatattctttctgtatttcttactcttaaatgaaatacagtgttcacctctgacactaacattcaacagaacgagcccctgtcaagaaattaatcaaagaaaaaatatatttgttatattttttctctctctctgtcatgattctagcaaacaaatagaaacaaggctaggcacatgggtgggtggataaatatcactcttcaagtagtgagattaattatgatatatgaatagttttgctatccatcattcacatttattgatagttgcatgaagaaatatatccaacctaaactcttattcttgttggaattaaattatcacaatttccaatcttatatgtgtactcacctatttactttttagccaaagaaaaatcaccccaaatttacaataatgtaacagcttagatattctaacagtaacatttatactcagtaatcacgtaagagcattctaattaaaacacattagcaactaacattccttaatctgggtatgcaggttaaaagccacatagtttcattacaacatatacaataaccaactcaaaatggattaataactttaatagaatacctgaagctctaaaactgctgaaagaaaactaagggaaaaactccatgacatcataacattggtctgggtaacaactttttggttatgaatccaaaagcacaggcaacaaaatgaaaaggagacaaataggattagataaaactaaaaagcttctgtagagcaaaggaaacaataaacag

SEQ ID NO: 197 - DNA, 3001 bp, Homo Sapiens
  allele 1501: 99-26233-275 : polymorphic base T or C
  misc_binding 1502..1521: 99-26233-275.mis1,  complement
  misc_binding 1482..1500: 99-26233-275.mis2
  primer_bind 1755..1775: upstream amplification primer, complement
  primer_bind 1254..1274: downstream amplification primer
  misc_binding 1489..1513: 99-26233-275  probe
  misc_feature 116: n=a, g, c or t
gcagaagactagccggaacccggaaggtggaagttgcagtgagccgagatcgtgccattgcattccagcctggcgacagagtgagactgtgtctcaaaaaaaaaaaaaaaaaaaanttaaaaaaaaaagaaatacttatcttctttttctttaatgttcaaattagctgaagcaaaaattaaacagctatccagcagttaatacactaaacaaaaccaatttaaataatagttatcctggcagaattgttgaaaattctacattgttttgactggccctagagaaaaatctgattcaaaaataaccaaaaatattcaatgaaaatatataatattctaaattgaaattgcttaagttgtgtaacattttcttatcatgataaaataaaaatctagaacaaggaaatcataattattttcctttgaatatgatgttttatgtacattttatacatatatttagactgtaaaacaattagaataataaaataataaaactaagctcaatttttagattatgtatccactttgtcttttgttaaaacagtatttttttggtttcaaagaaaatcttttatataaaaattgaagaaaaaaatacttaggcaatattataaggcacttcctggatcaggttataccaaaacacacataccacaatgtatgtttctttgaaaataatatatgtttgaaaataatttatggaaattatatctctgttttcagtaaataatgacaaatgagctcataatttaataaaatgaagcaacacacttaaagacactaaaaatatttttgatagataatatcagacacagatatcagtacactggaatgattgactatttgtaacatatattactagtagcagcagtgagaggtagagagtagataaacataatagaaatatcaagattcttatgacttaaaatttaataagtcaaaaagaacaaatggaattttatttgtatagtcttagaggaaagttgatcgaccagaatgaaaactattcgtacagaaattaagaatgtaagaaaataaattgtgccgaatattgtaatttaagagcaagtatttatactaaaattgattagaacattagaatttctggatcaaatgtggactgtcatatattatcagtggacaccagtggaacaataaccatgtgaagattttggagactcctgtctcctccaatccagataacctaaaatataacaacagggagggatgttacttacaagacgtagtaaaactcacctgactaagaagtcctgcagttctgacaatgagtttgactaatggtaagagctgtgtgaataggtagtgacaagcagctctgcaaaaccattagtttttgtttgttatatttatcaaattgacaaacatttttccagcagcaagcatctccattcctttgtatttcttttacctacctagcaaaatcagtttataattccaaaggcagaaactatttcattcatatcctgagctcttagcaygctttggttttgtagtgatgcggtaagggcagataatgcatctgcaaaatgaatgagctgctctaggtagaacataaaacagttctttttacatgatctacactatttaattgggtcataatcattttctcttagttatattttatattaacttttattaaatcaatttagcataaatgttacattattatgtgtttaaatatcacccatcatttctgtaaaattgaaacaaagtagaaacaaattaagaaagcagttgcttttcttaggaatctttatactgaaaaattccttaacttgttccttcttcccttgctccctttcttttctccctttctttcatcttccttccttcctagcttcccttcctcctctcttccttccttctggacaaatatgtagtttacttgatcttgtttgtagaggttaggagaacaagacagaaatacaacactagtgctcatttagctttaatcattttggaagagatgtaagatacaaatatgaatattatgtaagataatttgagtgctatgattttccctgggtctataaagactcacacttcctgattttcctttgtttacctaaatctagtagctaatgagtttcacagaagacaaaattcctacatcaaaataaaatttccctttaaattacctcaactagaaaatccttgtagttctcatgcaacccaatattctgagcctgttcccccatttcaccaatcacctttacctccttcagtccccaggctcccaggacccttttaagaaagcctgtggcccttacttaaagaggaatggacaccgatacatatgtccagcagaaactggaagtgatgtattacatctatgtgcctgttaataattaaataaatactttaaaaaggtattgcaactgctaaaaatctaagaacgcagtttgaaattaaatactattaatatttactttgaagtcattgtttttcttcttataattcgtattatgtgggttaagctagcaattgacttttggagtattccagacatgagatcattatacctctggatttctataaaagttgttcaccactacaacctacttgtctgaagcctggaacaaggggataccttcactcaacaaaagaaaataccagtattccagagcctctttagacagaaaattctgaattgataccttgccatgaatttggttgagagaaatgctatggagaggatattatctttattacatagtacacatttactcttctatgtattatgagttctatctctgagttcatctggtggtcagaaatttgaccatttcactgtattaaccaattcttttacagactatcctttacattttggtatttatttcacggctttttaattttaatatatcttttattaaagcacatatacttacagaatactgcccatgagatgcatgtacgattagatgaaatttcatgttactgacatgaagaccaacaagaatattacagggttgcct

SEQ ID NO: 198 - DNA, 3001 bp, Homo Sapiens
  allele 1501: 99-26234-336 : polymorphic base C or G
  misc_binding 1502..1520: 99-26234-336.mis1, complement
  misc_binding 1481..1500: 99-26234-336.mis2,
  primer_bind 1813..1833: upstream amplification primer, complement
  primer_bind 1379..1399: downstream amplification primer
  misc_binding 1489..1513: 99-26234-336  probe
tttcaaatatgtcctcatatgatcaccatatggtcaccagtgaccaaatcatttcttctatactttttatatttgcttcttcatctctttgtctactatttattgcctcggttctaatctgtttctactactgatggcctatttcaggtctgtatcaacttattctttgaaaaattttgaaataactgtttatactgaataaattgcctatgaggatggtagtgcagatgaataaataagaagagagtttgtaggcagaagatgcaaacaggacatataatctatgctccagaaatggttgttttatcctccatttatacttcaaatttcaagaacagctatgaatgtgttctgcaatggtttaatatagaagacataaacattatatttgttaagcaacaaggtcatggaagatttacctagtttgaattaaatcaatattgtttgttattctttatcctaatcccaaaagaccatacaaaatcaataagatattgatgtaactaaatcttcttcagtaagatttatgagacactgatatgagaatggaggttggctaagcagtaaccagagatatgaaatcttcatttgagttttcaaagcagcattatttctatgtgttttctttattaaactcaaacacttgcaccaaaactatatagtattatttagcattatatagtaaatcataaatatctgtataaaataaaatttgcagtaattacatgtatatcatatatttgatactataggtaacattttgtctttcacactaagctaaagttaattttataggtaaataaaaatgcatatatgtaagatgactgagtatacataaagcaaaaatgtgaaattgcattattggagaatcaataaagacaataaatggactaagggagacatttagttgatgagtgttattaaagttttaccatcataatttatgtttggtctgtgaaaaagtacttctttgaactataaggtatacattcaatatgtgttttaatgaagttttatatataataccataacgatttgtttagaattatgtattattttgttagctgaatttcgttttactttctttttcagtttactttaatcatttaatgaacattggagttgcagaataaaaatggaaattattattcattttaaggatgtttaaagcaatgttttagtattatcttttgttaatcaaagtgcattttgttgttgttattattgttccaagactttaccatttgcttacaattagcaggaactggccctattatttgatgtttgtttacgttagtatttatttattttgaacaagattagggagtcctataattaccatctcatcaatcatgagttgactatcctttggaaactcttgtggtaaacattaggcaggagccccaaatttgatgcaggtgagtaattatactgtaatcgtcactaaacacactgcaggcaaaaggctaagtgacaaagaaagacatgatcgttgcctaasagtccatgtttttgggtaattttattaaatgcaaattcagtgatttgcacacatctcttccagtagttatgccattaattagttttaagtttcagcttgagccaaaaagcactttatattttaaccataaccctgttgtattggttataagaagaatgaacacataatttaacttcaaacagggacatttgtgaaagtgaaaatagttgataatagtaaattggtggaacctgtaattctaaaccaggactttcccaagctaaccagaacatacgatcattctagttataagatgtacttcagaaaagaagcaaaattgttgataactctgctagtctccttcagggttctattatttttttatccacatttttctttttgtaagatgtgttacaaaatcttttttctagatttgatctccctatcagtacagaatgttttagttatccaaaaaagataaataatcacgtgctcctctggctccttttaatttctagttttgcaaaaacagctccaacatgttgcaaaatgattcaaacattttggacatcttgtaagatatcttcttatctttatttggctgtagaatgcattactattttccttctttgcagaaaataataatagataataagttattatccctagatagaaatcaaacatgtagagcttcaagctactttcatacttcaaagacatgattcaaggacggtttaaattaaaccagtcatattctaatttatgtctactagaaactaacaatatatttagtattatttaaatatataaactatgttctatattggttcaggtgaaaatttatacactaatattatgaatacttataacatcctagagtattcagtaagtaattgttgaataaataattaaataattgaattggcaagatatatttatataacttaaactcctaagtttaaacattatttgaatctaaaagtaacactaagttattattttattattacccatgagctaaaacataatttgttgcaacaccaaaattctgagatgggttcttgctgagctacagatagatgcttgtatattaaaaagaaatgctgcctttaaaaatgtcagttgtgacatttttacaaataagaatatattactcagacataatttatataataacatttatagatttgtagttatccattttcatgctgctgataaagacatatctgagattgggcaatttacaaaagaaagaggtttaattggacttatagttccatgtggttggggaagcctcacaatcatggtgaaaggcaaggaggagcaagtcatgtcttacatggatggcagcaggcaaaagagagagcttgtacaggaaaactcctttttattttaatcatcagatctcatgagacttattcactctcatgagaataccatgagaaagacctgcccccatgattcaattacctcccactgggtcccttccacaacatgtgggaattgtgagagatacaattc

SEQ ID NO: 199 - DNA, 3001 bp, Homo Sapiens
  allele 1501: 99-26238-186 : polymorphic base T or A
  misc_binding 1502..1520: 99-26238-186.mis1, complement
  misc_binding 1481..1500: 99-26238-186.mis2,
  primer_bind 1668..1686: upstream amplification primer, complement
  primer_bind 1235..1255: downstream amplification primer
  misc_binding 1489..1513: 99-26238-186  probe
tttctccttaacttcttctagtggatgaagacttcctatacgttccttgtctttcatgactttgatacttaggaaaagttggtgttttgagtattatgtaaaaatgccacttaatttgggtttggttgattttgtaatgattcaattgagattgagcatctggaaaaagaataacacagaagtgatatacactcttggtacatctcatcagagggtatattatttcaatgtggtttactatttgcgatgttagcattgatcattggactggaataatgcctaccaggatttttccactgtaaaattattattgttctctttatattactaaacattttgaagagtatactgaaatcatgtaattatcttgtctcccctttgcatccatcagcaaatctatcctgcagcaagtattaccgatattttctattttcctcattctgactacgtgtattgattggaatgcctccataagaaacagttaccccttttctcccacttatttcgtcagtcatttatttatactagtatggacttatgaatatttacataattcttgaaatttcaatccacatatgactttacgatagaaatcagaaatgcatcaacttttgtaaaccctaatgagaatgtacattgggaccctcattagtacaaactctgaacaatctgttgcatagcaaaaagagaattgttgacagcagatagagttcaccatgtgatgaagctggtagtggcactatcattcattcattaacttatttgctcttttcagatatatttattgagaacctactgtgtgccagaccatgttataggattggggggtacccattaaataaaacagatgaattttgccacacagagaagtctagcatagagtaagcaaagaaaagaatattagataaggaggttacagaagtcatcagaaacgagactattcaggacctagattttactataattttgcttgtaaggcccaggcagatatttagtaagggacagttaatattttaaaatacaaatatatatatatattatatatatatgagaaacatatatagtatatagatatagcatatatattatatatactgtatatatagatttatagcagtacatgtatgtgtgtgtttgtgtgtgtatatatatatagagagagagcagtacaaagttggaagcatggagatttgagtaatctaagaaatcacgtgatttgaactaggaagctattagctaagatggtcagattcagaatatcttcggaagtttaaattctcaaattatctgacagattgaatatagggtataaaagaacagtcaagaaggtagacttcaaagtattgaaactgcgcaagggggtgaatgttgcatttactattttgggagggaaaagttggaaaacagagcttattagaaatccagttagaattctaataaacacctgtatacataagtctagattttagccacgatgagcctggggttgcaaactttgaawtcatttgtgtataagaagcattcagttcctctaggagagaacgttgggtggagtaaatttaaaggataagcgattggaaagttaaggtattggtgcactgtaaggttgacattggggcattgagaaagggaatccagcagataaattagggtaaaatagaaaatgacatagaagtcgctagatttgtgcatgcttttgtgtcaaaccagaagagattctgaaatctagagaaggctccgtgtgtaattatttcaagacatgaggccgctccatgtatattcatccactctctgtgttttgctttattttaatctttgataaaagtaaggttgctaaagaaggaacaaggcaaatgaaagattaaaatgttgagagtataccattgagattaactgagacgccattagacttactaacgatgctgttgaagaacctttgaaacccattattagaataaagtggttacctggaatgagtctattcagggcctagatgttgttatagctttgtttaaattataatacagtggcctaaaaacaaggagaataacatttcaagaaaaggcagctctctcaggtgttgctaatatgtccaatgagatgaaaaatgtgaatttaccattggatctggtgatgttgaattcaatgctgactttgacaagagcagtttcaatgaagtaatgggaagaaaagcccttctggaatgagtttaataaataatgggaaaaggggagttaagagatagtgagggcaggtgtggtggctcacagctgtaatcccagtgctttgggaggccgaagcaggaggatcacttgaatccagcagttcaaggctgcagtgagctatgatcacaccactgcactctattctggggaacagaatgaggcctcatctctagaaaaacataaaataaattaaaaagtaatagtgagtactgattcatatgagtgtttttgctacaatggaaggtaaacaaatggagttaatgctgaatgattaggtggggtctaaagaaagtacttaatggtaaaatactatttttattaagtgaaagtgtaaatagttgaattaatgagtgaataagcacttaaaagtattttttctttattctaataatgggtgtcaaaggttcaacagcatcagtaggtccaagaccaaaattcaggttctaataaattctcagttaatttcaatactatactctcaatattttaatcttccatttacctttttctttctttggaaaccttacttttattaaagattataataaaacaaaacacagagagtggctgattgggcatggagtggccttatgttttgaaataattacacgtggagccttctctggctttcagaatttcttctggttttgacagtaaagcatgtgccgatctagttaagtatatgtgatgcactcatggtgtgaccggcaaaggtatagctgtacattctggaggagaaaattgttgtaggaatgattatttcatgctgctcttca

SEQ ID NO: 200 - DNA, 548 bp, Homo Sapiens
  allele 79: 99-16106-48 : polymorphic base G or T
  misc_binding 59..78: 99-16106-48.mis1,
  misc_binding 80..99: 99-16106-48.mis2,  complement
  primer_bind 32..50: upstream amplification primer
  primer_bind 518..535: downstream amplification primer, complement
  misc_binding 67..91: 99-16106-48  probe
gagagagagagaagcatttgaaaaacatgaacattaggatttgaacagagccttaacacctaaaggtatgaatatataktcagacaaaaagcaattaatgggcagctcagctggctaacatgagagtaatgaatcatgataagctattggactgacatgttcatgattaatctgaacttaaaggccactgtgccctgactcaggaacacacacatacaacacacatatgcatacatagacacacatatgcattattcaaagacagacatgcatacacatggacattcaaggaaagctgtatctcccagacaatcaccataagcaaatccatcacacatgaccaggggacctgtttaaatgatgcctcagtcatgtcatatctttactccctgtgcaacaaaaaataaaatacaagccccacagcctggaaaccagaaggacccttcataatatgttcccaacaagccttcccagccatatctcttatctcttgattctcccagaccagtatcaaatgctccatccaaaccacactcctcaacattcaa

SEQ ID NO: 201 - DNA, 478 bp, Homo Sapiens
  allele 125: 99-25332-125 : polymorphic base A or G
  misc_binding 105..124: 99-25332-125.mis1,
  misc_binding 126..145: 99-25332-125.mis2,  complement
  primer_bind 1..18: upstream amplification primer
  primer_bind 461..478: downstream amplification primer, complement
  misc_binding 113..137: 99-25332-125  probe
aacacaggcacatcattgctcagctgacctgaaggcatgcctgccaggtgcagcttacagggaagttctcaggcctgggttgcatgtacaaggctgctcaattggcctgggggtatatttgcaaraagcagcccacaggggtgtttgtcagtcccagaatgtagtcacacacttcttagctggcctggtgtgtgtgtgttgggggtggttgacagggcatttcctccagctcaggacacaggcgcacagctattcaacaagcctggggacatgtctgctggggttagccaatggaatgagccaattcctcaggtccaggacatagatgcatggctccttgcctatcctggggatgtttttgtcaagggtggctcacactgtattttgtaggcccagaatatggacacagggctgctcagctggcctgggaacgtgtcttctagggcatcccacagagttgcttctcaagtctgagaca

SEQ ID NO: 202 - DNA, 404 bp, Homo Sapiens
  allele 306: 99-25516-307 : polymorphic base C or T
  misc_binding 286..305: 99-25516-307.mis1,
  misc_binding 307..326: 99-25516-307.mis2,  complement
  primer_bind 1..18: upstream amplification primer
  primer_bind 385..404: downstream amplification primer, complement
  misc_binding 294..318: 99-25516-307  probe
aaagtgaccaactcatcctgtttggccaaggactgtcctgagaatcctctcagtcctggaccaacgagggcagttgttcggtccccttaatgcaaattctggcaacacctctctgacattgacmckwccattatccccatatttcagagagaggrctgaggctcagaattctaagaacttgcccattatcacacaggtcctaagagctccctacttagggacttaaatccaaatcttggactctgcgacctccgttctcaccaccgttctgtgctattccctgagaggcagcgcaggtccttgcgycgcagatggggctgcctgtctccaaggccttccctgctcctatgacagtggaggtgtgaaggggattggaagtgtcctcgagttctttctgaagaaac

SEQ ID NO: 203 - DNA, 3001 bp, Homo Sapiens
  allele 1501: 99-26173-470 : polymorphic base C or T
  misc_binding 1481..1500: 99-26173-470.mis1,
  misc_binding 1502..1521: 99-26173-470.mis2,  complement
  primer_bind 1033..1052: upstream amplification primer
  primer_bind 1570..1589: downstream amplification primer, complement
  misc_binding 1489..1513: 99-26173-470  probe
tgtctcctctcccatttctactctcagctatatccttacttctatttgtctgagaaagtagaaataataagaaataaatgttcacatactccacaactgcttttataagtctatctgcagatctatccatttactcctctttttatttttttactgaacttggggataaactcctagtgctgtaatctaagttcaagacctcatcaaatttagcattagaccatctctcctactcagggaaatcaatccaataattttcttctcttctgcatcatcctactgtgttatcccacatcctcctgtattatccttaacagtatttaaatatgctctaatatttagaacatcttaaataattaccccatgttaaaaaagaatcccctcttggttatgcatttctctctagctattgaattaattgtctgttactggcaaaactctttgaaagagaaattgcaactatccttctcccattctctcttggaccctttctaaacaggtgtttgtccccagtaacaaactgttcttgtcacggtcacccatgacctgcaagtgatcaaactcaagattctgttttcagttcttatcctacccgtatagtatttggcattcaaattttcataataaatttgtattttttactacaaagtggtaaagttagcatcgaaatactttaaacctaccatttacccaaccagtaccctttatgcgatcatctttttatagtgacgatatatttgggtttctaattgagagtattaatacgttaactattccatgtgatttgatgttcagccaaacactaatagtactcagttggtattcgggtaccattagaaggcaatgcttggtgtttccttacttgggaagaatattcctttcatcacatgtatttgtgtttggacagagtggcttgtctctataaaacagaagaagatgaatggtctttctgagaattagtctttgtatttaaatataatagatttgtgattaagcaacggctgcttttcagactccttaattactatcatagcaaataatcattggcaaactaaaatattagtttgcttaatgataaatatcactcaagtttaagcattatgtagaaagaaatagtcataaactttggaagggccgtttatcatagttcattttctctatgtggaacgttttcatggatagatttgttccttatttttacacctaagggtttcaagtattgataatatgttctacctcttctttacctacctattacacagacatgattaaggtaatgtttctacatttgtgtttttagtttttctatgttaattttttgtcaaaatgacaaacagcttttaaggtataagcaaatggcaaagagctggcaattagagtagatgaacaaatttatagacatgataatattatctcttccattgagattttccggggtaacatgtaactacttggctcaacaacgagacatgaatgcagtgtcttttctcaggaaactctycaatgatggatgggtatttacttgtttgttttcttcagaatccaacaattctctttcttttgaaaaagcctttaaaatagtgcgattctcattgcttaatgtctttttattacaccacatgcctcattttatctctttgaatttctgtaaataattcctgcttatccttggatacaacatgccctttaaatatttgttcatggcttttttattcctcttaccatttggccaacttacaattgtttaaccctattaatctttctgcataagtaaatgccaccagcaccttaatcatttctgtggcttagattgttcaataattacctcatccttattccagcaaatgagatgactgctgttttcatgaagagaatttcatgctgaggccaaacttggggtagagaagactgaatgcatttgctgtcttgcttctctctggggtgggatctgatctgaatacagggataaggatattgtacaaatctatgctaggtagaagcagtcttcttggtttcatacctgatgaattaaaggaaagtgtagggaaagtaaccagacatcttcactgcatctgctcagatgagaagtgttgcataccacatctcatacttctcccaacaacagggtgttgttggtattattttcatttcatggatgagaggaagtgaaggaatttttccaggaactcatagtggtcaggggtagtatttgaacacaagtctgacaaatatggggtacagttttagaattaactcaatgaatccttaatcataataaaagtcagcattatactctagtgtcttcctggatgtacccatagaacaggctagaatgtcaaccacaagattccctctgttcattcctataatttattattattattatactttaagttccggggtacatgtgcagaatgtgcagttttgttacataggtatacatgtgccatggtggtttgctgcactcatcaacctgtcatctacattaggtattcctcctaatgctatccctcccctagctccccacctcccaacaggccccagcgtgtgatgtccccctccccatgtccatgtgttctcattgtccaactcccacttatgagtgagaacacgcgatgtttggttttctattcttgtgttagtttgctgagaatgatggtttccagcttcatccatgtccctgcaaaggacatgaactcatccttttttatgtctgcatagtatcccatggcgtatatgtgccacattttctttatccaatctatcattgatggacatttgggtaggttccaagtctttgctgttgtgaatagtgctgcaataaacatacatgtgcgtgtgtctttatagtagaataatttataatcctctgagagaacatgatgcagaaactgctgggacagtaatgttacaaatgatggccaccctgcagaaaagagccttctccagatctgcctccactcctttctgttcaatgcatgggacaatagttttaaaagtt

SEQ ID NO: 204 - DNA, 3001 bp, Homo Sapiens
  allele 1501: 99-26267-524 : polymorphic base C or T
  misc_binding 1481..1500: 99-26267-524.mis1,
  misc_binding 1502..1521: 99-26267-524.mis2,  complement
  primer_bind 983..1002: upstream amplification primer
  primer_bind 1553..1573: downstream amplification primer, complement
  misc_binding 1489..1513: 99-26267-524  probe
tggggttccttaaccttgtatctaaattctcacttcacttggatccttgatgataggaatctgtgagataaatgtcatagtacccaccaacaccatgtgctcagcagtcaccagagaacaggttcattatatcacctttgctttaagagattcagcaatttccacgaaggcccacaaagaggccttgctgaaaataatttcaagtaattcatcctgcctaagtacacagactccaggtgcagggagattgaagttttgttcccagttttgttatgtaatagctttgtaatcttaaaacatttcttaaatatcctgaacctcagtttccttatctgtaaaatgcttcatatgaagtttgtatctcacattgttgttttgaatataataacgaatatcaaccacgtaacactgcctggcatattataaattctcaatgtctcttgtttaagagtcatttaaaatgtaattatggctgcatagtattccatggtgtatatgtgccacattttcttagtccagtctatcattgttggtcattgagaactgaacaatgagaacacatggacacaggaaggggaacatcacacaccgggccctgttgtggggtggggggaggggggagggctagcattaggagatatacctaatgttaaatgaagagttaatgggtgcagcacaccaacatggcacatgtatacgtatgtaacaaacctgcacattgtgcacatgtaccctaaaacttaaagtataataaaataaaataaaataaaataaaataaaaatgtaattattatttgtagtagaaataatagtagagagaggtagtgtgatatggtagaattcgtgatctggaagaccttaatccgactcttgtttcttataatttagagaagcagggctttgggtaaaccacttaacttcacttgtaaaatgaaagtattaatgaatgcatcacagggtccctgtaccaatgaaatgagctcctgggtagaaaagtgcttcataaacgggtatgtgttacataaatgttaattattgaaatatggagtcattactaaccttataaaaaaacaagcaaatgcattttacatgtaatttttactcaattatcctttaagtttagtcacaattagtagaaattgtccctaataataaacgtaaagaaaggaaagcacacatactgacaaggggttattgattttagaagaaaggctttcatttttttgatattttgctaccattgacttgtgatatgggtaattttctaaattactatacttcagtgaagttataattgtctaacttattttatgatctatgagtcattataaaaaggcttatgatttttaaactcactgtgaaatattcatagaaggtgtttcttctctattctgttactgcaaaaaaatcagtgtaatgcctttgtcatattgtgataaacattaaaaaaatacaagctgatttttcccaatattatcacattacaatttctttaactttyatgggtgttctttttgtttctggcaacaagtgccacattgctgaaaagtctctaagttcattttggcaaaggcttttctttttaaataaaaaaaattggggatagaaatatttcatgtttttttatccacaccaaaatatacaaattattgatatcataatgtaaataataagaccgtacattgactaatttttaatgaatattttatggtcctcgaattaagaatgtacaatgttgaaaagattgaaaaatggtttggggtagtggatcacatgtgggatggtgttgaatggattgctgacaccacatgagttcatgcacacatactttgtgggcaactgtggtgaaatcaccatagactggccattaacttacaatatgtggatattcttagtaatttatatttgttggcagttaatatctgtttcagaaagcttgaaaaggaattttgtgtgtgtgtatgcacgaaaccttttccccagatcatatttgtgtgtatatatataaaatggaatatatgtatatattatatatgtgtatatatgtgtataaataatatatatacattacatataaatatgtatatttatacattatatataaataaaatattaaatatacattatataattttactatataattttatagtttaataatgtatataattttacattatacattatattcatatataaaatatataacatatataattttactatattatatattaattataattattaatttaaaagtgggaaaaacttttattatagttaatactgggtttagctctagagtttaaattttcagggatctctttgtagttatctctgataaccacaataaaaataatagtggtgacactaatgataactaatatttactgaggacattttgaagcagacctcttctaagtgacgtatattcacaacactgtttaaacttcataagtagccaaatcagtaggcactgtgatttttccttttctctgggtgaagaaattgaggtgcatagaagttaaataagtaatttactaatgtcttgctgtgaagtgactttgaataaaatattcccattgacaaagtgccaaatatcttaaattggaatactagctttattttttactttgaattattcttgcttttattactatcctgttaaataaaaataattttggaaaggctaatacattaagtcattaactcagtgttcattagttaatgtcttagagaagcaagtccccagggaagctcagaactctgggtgaccaagataggcagagaggattgtaagagtgaggaagagaggaagtgggttgcagtgagcaaatctgcctaaaggctacatgtaatcatctcatacacgtggtgtacttagaatcattttaggttatgcaaaaaaaaaaaaaaaaaaagaaaagaaaaaaactcaaaataatacagattgtaaaatcctccattctacctacaccaacagctcacacacttcttttta

SEQ ID NO: 205 - DNA, 3001 bp, Homo Sapiens
  allele 1501: 99-26284-394 : polymorphic base G or A
  misc_binding 1481..1500: 99-26284-394.mis1,
  misc_binding 1502..1521: 99-26284-394.mis2,  complement
  primer_bind 1874..1894: upstream amplification primer, complement
  primer_bind 1460..1480: downstream amplification primer
  misc_binding 1489..1513: 99-26284-394  probe
acagtgtcataacttagcaggggttctgggacctttttttccttccagagtattataattctctgaaatccaagaagtacaaactttactttgaagagattgcacgtagtagattgtactacttgtttccaattacatccatcccctttctaccccgtcctgtgaagtaatatgttcacttctccatagattttggggttaggcatgcttctagctttggccagtgggttgtgaaaagataatgtgtttgccttatattagcagaaacctttagaaatattgcaagaaccctctttccccctcactctgctactggagctccttccctcaacctgggaaccatataaaaagacatggagtgccacactgagcggggctgggctgattcctgtagtgcccagcagaacctggcagaactgcaacttcccagagaccccaggtgaccttcagcaagaaccatgagtcagttgtaagaacttaagatctggggcttatttgttgcctcagtaaaagctgaaaaatacatgcgctctggtatgaagaaatactgggatgtgcatgagataaagttcagatgggacccacaaaaccaaaaattttccaaatcaaagtgttaaccagctcttctgatcttccagggtctggggaggcaccagtgaagtaaactgacaatgataccagctgtagagaagctcctattgcagtgcaaggagacaaaaatggataagtaaaacattctgtgtattattaagataaatgttacagagaaaaatatatcaggaaagggagagaggaatatatctaaatggagaaaggtgaaattaaacataggatgtttgagaacatctttactgggaaagtcgcattggaataaatatatgcaggaggcaaggaagcctgagttgatgtgggtaaaggatgtttgtaacagaggaaaccaaaagtgcaaatgtcttgcgttgagagcatgatggttttgatgaaaatatttaatgggtgtttgatgaaaatgaaggagaacgatcagtttagaaaaaaataaaaggtgagatacatatcaaatcgcccagcggcttgcggaatgcagatttctaagctctcagagattctgattccataaacctcaggtggggcccatgaatttgcatgtctaataagttctcagggaaatactgatgcagcgcaacaccaggagcaccttgggaactacagctccagggctttgcaggttgtgaggaggacttcggtgtctcctctgagtgagatggaaaatcacaaggatgtttttagcagaggagagacattagctgaccaccaggatgattgtgactgtgttgagaataagcaagaaagtgctaaaagtggaagcagagaagccaaatatgaacagtactgaaacatgggacaattatactggccttatgcaaaaagaaaaatgattccttttgtttagtaagaggtaagacagttcctgatgcgggtcgggacatgttgagagatrttccaaccaatgccctctgttttctctggcaaggtcatctaacttgatgagtgggaaagtgaggaggggtgttggttacttttgcagggagaataaaatgatcattgcagagcgtgggagagctaattgagtgaaaaaatattttattattccagaacacccttccataaacaaatgaggttatgactatggatttgtagttaagagatgttaaaaggtacatcatttgttaagcttgttaaactaacactaggaccactcttggcacttacatatcccaaatacaaaacccaatacatcttccttgtttcaaaaacggtctcttggaggatgatgcccaagggttccttgagttttaatgaataagcatttgctgagtgaatgcaccaacactttgtgtaatactaccagtatcactttccttctgccaaatactttaaataaaaactccaccaaagatgacgtaaaatagaatcaaaacctgctggtagggtgtataagcaagatagaatcagagtttactaaaatcagtatttaatggagaagatgacggcagtgatgatattagctaaccgtgctgaatattattatctgacaggcactcttctaagccttgtcctgttttaactcatttcatccttttcaaaattggatgagattggtactaatattattcccatttcgcaaagatgaaaactgcagaccagcagtatacccagtgttgcacagacagcataaggagcagtgaggtctgaactaaggcattctgcccagggctctgtgctttttaacaactacaccagaagcaagtgagaattacagaatgttaaatttgggctcttttgtttttccttttctaaggtagactgcggggaatgacccttgtaactgaatactgcaccataattataatgggaagctgtttctatctcagaatctggccctgaacgatcctaggatatttaggccaaaaatgcaggggagagagtcctgatggggggcgtggctgtgagtggagggggaaggaaagtgaggccaaccacacactttctgctgcagattctgcaccctcttggaaagacactgtgaaccacattgagctaactcttgatacacccgcagatacccacactcactgctcttcctaaagacaggcacttggctctttaaccttgaaatggggaatccagaaaaaaaaacaaaacagttaaagatattttattcaattaataccttgcaccaagccatattaaaatgttttctgctgtctccactcttgccctctcaatatctttcaatattttagatatatatatatctaaaaatgttaaatttaactttgggaggatttaaggatacttataaaaataaccattcagttactttctaataatcatttatccaagtttaggattcttgcaaggaagaagacattaaaatggccgctctactacttttatctgctagtaaataaattcatgatgaacatttagaaggtcg

SEQ ID NO: 206 - DNA, 3001 bp, Homo Sapiens
  allele 1501: 99-26559-315 : polymorphic base A or G
  misc_binding 1481..1500: 99-26559-315.mis1,
  misc_binding 1502..1521: 99-26559-315.mis2,  complement
  primer_bind 1187..1207: upstream amplification primer
  primer_bind 1650..1670: downstream amplification primer, complement
  misc_binding 1489..1513: 99-26559-315  probe
  misc_feature 539..540,592,784,833,850,881,1592,1631,1682,1852,1873,1962: n=a, g, c or t
atcacatgcagtagcttgaaatcattggtgatggatttacattttaaaaggctgaatcagatatagaaagcaatttatcatggtcaatacaaagtatatgtacattgtcttgtttaatatgaaattttaatatagtgtggtggcagaatctgtgctgttaggtgatattatttggctaacaagagctgagaggggaattgcagaagcataaaatgtcagctggaggagagatcataaaaagctcatgaaggaatcgcctttggataaaagaaaggtccagaagtgtggagagtgtgctcagaatactggtctctaagacatattttctggagtttttcaacaaatacttcatgcatggctactcagtagcatgcacagtgccaatccattctaattctctatgaatatcaacaagagttttacaagacagtgtcaaagtaggttagttgagagtcattattcattaaatagcaatgaagtcacctaactgaaacttaaggcagatatcagcaagagaaaacaccagaagaatacacatnnaaaaatacatcagatcaagggtaaaaacaaagaaatatccaagatgtaggtncaggctttgccctttcaaggtaacaaactgagcacatactgcaacctcttgcccctggtaaaacagcataacaagtttaaatacagaaataaaaccataattgagttgtaagtgttgggaagaagaaattatcatctctgaggcagcatcagcatggatagcacattccatgctcagtagatgtgagagtcntaatgactgtagcactaggtggtcttaggtattagagaggtctatgaangcatagagatcaagccngaaatctacctgtcattggccaatgacaatnaatatgaaaacaatgaaagaaaagtccaacgaaatagaagataggtccagatgttccacacctcatctaacatagtagttctcaaccagaggtgatttgccactgggcatttggcagtgcctagaaacatacttcattgtcacaactgaatagaatagtggaagtagctgctggcatttaacaggtaaagacaagaaatgctgctaaatatcttacaatgcactgggtggccctcaatccaaataattatttgacccaaaatgtcagtagtgtcaattttttttttaatgctagaaattctggaagaaaaaaaggtgcaatgagtggtaagtgtactatagaaaattattagataatgttatagtcaacctccaaatttaagttgtgtgacaaaagagaaacatacttttactcaaataaccattcaatgcaggtgatcttgggcagtgaataagaggcttttctccctgggttgattcaggcattcagtctccttccattttgtagctcttttttttttttttttttaatcaggaatggcccaagaatcctgtgtctgtagtgtgacgaggggaaagagtaagtgaatgtggcatatcagcttcttaaatacccacacrtcacttctgacaggtactgatgtggatacttctagttgcaagaggcttaggatagttagtttctggataaacagctatgttgcaatgaaanctcccatactatagaaagagcatggattttgggaacaanctagctcattcaagactccatctgcccctcttacaagaaaataactgcatngagttactttttacttgtacagagaacattttccatcctttccaaggaagacaaagcaaagtcccatccagtgtctgtatccagatcagccttgaggaggatgagacgaatcatcagcttcctcatctgttctacatgaaagttagatgacacatcagtctccccattgnttcccaccaccaaaatcaaanttatagagtgatggagcctcaggtaatactgcataatacccgagagtcactaggccatatgaaatgtgctatgcaggcagggggagggnccccctgcccttgcaatgaaggaagttccctgacaagtctctgaatctgctctctgtaaggaagtctcattgattgaaagattcttccactatacatcctgtcttctgtttccaaatgctgggaacttcctccttgttcagtttcttcctagaccacatctgaaagaatgccatcttggagaagagaatgccatcttggagaagagaatgccatcttggagaatgccatcttggagaatggcagtttcctagcctgattttgggtttttcaccatcataggattacttgggccagactcaaggtatccttgggaatataatccccacaaatgccattggccttttgagctatttccttctgttttcagtaaccccaggtaaagtcattgtctctgtgtaaatctcaagttggccaatttcttccgcctatgttttctctcttgtaaacctaaaggagaccactttgaaaccatttaaaacaatttggtgattaagattaagattaaaacagattaaggaaaccattaatctgatctttgccacagggcttagcttccctgtttaagtgatgattcttccccgaccttgttgttcaaagtttttactttcagccttattcatttcactctggtattcagccaggttccagttttacaatgtgccacatctctgcattctctctttggcctttacttcttatctcaaacaaattgacttttgctcaattttatctcttgttgcatcaagaaactaccatcacgtgcaactaatagttatctaacctcgtatcttgaagctatgggcttggccagcgtgtgttctgatttccaagttatcacagctggcagctattgtaatgggtcaccacacacatattgtgaccaatctttatcttctcagactctggtatgtttcctgactgttcatcacttgattattgaagcagtactgcatgttttcttttctttgtgtatttgcactctgagacctatggagtattaggtaagaaataatagtcacacttagatacattacagta

SEQ ID NO: 207 - DNA, 3001 bp, Homo Sapiens
  allele 1501: 99-26769-256 : polymorphic base A or T
  misc_binding 1481..1500: 99-26769-256.mis1,
  misc_binding 1502..1521: 99-26769-256.mis2,  complement
  primer_bind 1249..1267: upstream amplification primer
  primer_bind 1707..1727: downstream amplification primer, complement
  misc_binding 1489..1513: 99-26769-256  probe
tctgcctgcctctgtcatattcacattctattcgaccaatataatgttggggctctttcacatcagtgagggttgtctgtctgtgtctggtacacagtaggcagatgtgatttcatacttcgcctgggtactatagacctaattcttactatttatggctagtccctaggaagactttatgttctgactccttgttgctatattctagactcactcaaaaatgtatggatggacaaagacagagatgtgtggatgtgtgtctctggggaagttccatgggcaaaactgtttcaaggaactgctgtgactctgatctgtttactacctctcttgtggcagaaatggcagacatttaaaatttccacttgcacattttttcaaattaaggcttcagagaaatgtgtagttgtgtgtgtgtgtgtgtgtggtgttatcatggtgtgtatctccccattgtttaatagaaacactaagatactaagtatgcacaattttgggaaatacaaggatgtcatcagaattttgcagattactattagtttctgttttcttcttgaatagtacacattatctcaggatacaatgtaaaagtttgccctatgaagttccagaaaaaaatagtgaggtttatcaaatccatctgttcccatgagaaggaaacattacacatggccaatattttctagctccaaagaacactttaccagttctttagctctcattgcagttgactttttaaaaattaatcagtcttcataagttagtgtttcccttcccttgattttctcatccttttagaatttatgtttcaatatgtgttatttttatatgaatttaacagagaaaagaaacaacaataatgagaaagatggaagaggaacaacagcataagaaggaggggaggcaggaaggagggcagagaagaaaaagaggaagaagagcaagaaaaatgaatgacgaacgaatttacaggaagagacaacttagagagtagagacattgttgggattttcaaattaatccagaatcttaaatcaggctggaatgttaggcacagacacacagagagttgggtttttagcggttccgattctttggtttctttattatatcatcatttgcagtattttctgagagcagtagattttctcttccagtctcatcttattgaaaattctttgtaaatataatctattctcacttgttcactttctggtgtatcttctaatttgaaatttgactttcgttctcagcgtgctactaaaactcctttttaaaattttccctcttacttgttgaatccaacagctttttcatttgttttcagctctccaactttttttaaacttgattgtaaagcttagatcctttggtttttacagtagcactctgctgactttattgccatttccttcaagctagttcccgggctcttttgccagccccttcaaggcattcacaaagttttgtcctcagtcttctactagtcccatttgtcacwgcaactttaccatcccacatatttacatagttcaaaccaccacatttatgctgaagacaacaagcctctgtttccaggctcaagcagctcatgtgagtttctgaatcatgcactcaactgcctgctgaacacagccatttttatgttccgtgtacagctcaagtttcacaagtcaaaaaacaaactcatcctctccttgagtaaacctgcacctcttttctatacctcttatatctagtcaagaccctggagaataatcctgcaggcatttatcttcttacctcttttaccaaatcattcttgaaactttatgttacttcccaagttttaccaaattgactcttactctctactcccatttgtgatagctgcagctcattctctgtcttatttatgtgctactgttatagagtgctgaatgacatcctgcatttgttctctaatctaccatttgcacatatactcaagatttatgtaaactataaagctcactgcactacctacctatataaacattccacatgctctcataattaagaaaaacacagtttaaacttctcaaaatggtatatggtgtctggaattgtcttcctttctagcaatcttacttcttgtcaatctttcctttgggattcaagctgtaacatcccagtctgtttatgatgctcttgatcacaaaattctatttccacatgtagaccatctcccatgctctaccttccccttgagaattccttttcctctaggattccaatttttatttttaaaataaatgactaaagaaggtctctccttattgctggagaccgcggcaggggtcccgcctctgtgctgccattatgttggacccattactgctgttaaaacatcgtcatataattatgcacctgtgcctgccgaaggctgagagcttgcacataaagaaagctggaaagtgttactcctacccttacaacaaaaaaaacacaagacacatcttaagtcagcaactttccataaaaccatcagagaatgaagttctaagggtaatcaactgtcccaaaatctggagacacacagactgctgcaggatctgagtatttgtttacctgagatagatgcccctcaatgccatttaatctggtaagaaaattcagctagaaatttagaatgccttggtaaaggccaagtacgatccagtgagagagtatagggaagtctgcaccctttggcacgtttctatatcaggcactcaccgggaagatggggaagaatcatgaaaaactcaccttttattgtgctgggttggggaaatagcagtgtctgccttaatctgtccatacttattactttattggcctatgaaaaataaatcaaaacaacaatctgcagaaggacaacaaaaggaaataaaaaataaaaacaacacaaaaaaacctgcaccataagagcatagattgttaaatcactcaatttattgtttaaaaattgaatgcagaaaactgtgagtatgcattccaa

SEQ ID NO: 208 - DNA, 3001 bp, Homo Sapiens
  allele 1501: 99-26772-268 : polymorphic base C or T
  misc_binding 1481..1500: 99-26772-268.mis1,
  misc_binding 1502..1520: 99-26772-268.mis2, complement
  primer_bind 1235..1254: upstream amplification primer
  primer_bind 1702..1722: downstream amplification primer, complement
  misc_binding 1489..1513: 99-26772-268  probe
gcctccaaagccatggggaactgtgagtcagttaaacatcttttctttataaattaccccagtctcagttatttcttcatagcagcatgagaacagactaatacaacagccctcagtaaaaactgtgctagtaaatttcagtagtttctcactgaagtctctgttgaagtcagtcttaatcatcaaaactgtaaaccaaatcttccactttcaaatgtgttctaaagcaaaatgttcaaatttctaactatatcaaacattcaaacctgcaaaaacggcattctgcttataggaaaatgttgatctcttcttacgtttgatactcttgcatgaatacaatttttttttccttattcccttctcctcctcttcttccactaacttgttgtttacataataagttttatgtcatgctagtagagttggtatgtagttgcataaagacataacaattggaatggtgttagctagtaaaaatttaaaattagatcaagatcttcaagatcctcaaccacatattaaagcttcataattttgacatttgggagaagacatgagagaggttctttataaaattcagtttcaagaaccaatttcaaggttgctatacttatgcaatttagtaaaatgcacatagtaaaagtctgaagtgttttatggatttctctttttcacttactttgccaaattaagaacatggtaaaaacttgcccttatagccatctaagtctccgctataatttgaatatatcccacaaagttgatgtgttggaaaattaattcccaacacaaaatttgagagatgggacctttaagaggtatttaataataaattaattaatgttgtcattgctggagtgagtttgttattgaaagagtgagtttattataaaagtgagttcaaatccctcctacctgtgtgataccttctgccttgttacgaggctgcaagaaggccctcaccagatacagccccttaattatggacatccttgtttccacagccatgagccaaataaattttgattcactgtgaattacacagtctgtggtattctgttacagcagcacaaaatgaactaagatagaaaatgatctctaaagcgaaaaatgatttctaatgcataaaatgtaatatttttattagtaatttacagtgttttaaacgtaagacggctgaggcaatatgaaactgatgaaatgaacagatataactccaggtaaagactaagaacattttctaactttgtccactgccaccctcctcctcatccacacgtaaatgcacccatgtatgcgtgattttgtagaatacatatatcaatgagaatatgtttattccagtggaggaggagcttaaaatctcacatgttgatatacaataagcatttcatcttctcataattatccacagaagtatcacagaagccagtgacaatgcttagaaatgctacagaaaatacaactaaaaataatttaattgtaaaaatccaagaatttyatagttaaaattctaaaatatttcaatttaggtatattttttaccctgtgtagattacttctctattaccatatttgaaaaccaacatttcaatttaatcaatccatgtgcctattcaaacatataattacactaaaagacaagggtatccttagccacaactgaaggaatgatcaaattcgactccctggctttctctgcaactttctcatcctaatttctttaaaaatatatataaatcctgttcaagtaactgcaaaatcttctcagtgagtgctatggatccagacttttctttacatttttgcaaaatcctgctcacttttatatatttttgtaggaagctcatgagctaactctttggaaaaagtctgcaacatcaattttactgtttttgtatttttctctttcagaaatatctgaaagttaaataagtcattatgtcttcacatcccaaatttcttcattaaaaggaagctagcagaagacaagtggaggccaggacatttttttgactatattcgatttgctcaaatgcttttttcttcatctacaaagatgattatgtgttttttgtcctttattttatgaaatggtttcatacactgtttgatgttcacatgttaagccaacattacatttctgggataatttccacttgatcatggtatatgaatttttaatatgttactgcattcagtttgttggggtaagagtttgtttttaggattttcacatttgcattcagagaggatattagtctagttttttgtttgtttgtttgtttgtttcttgtagtctttgccttttttttttggtatcagagtaatactggctccttaaaataagagcgtttgcccttttcttttacttttttctttttggcagaggttggggtgagtgttaatttatctttaaacatttgaaagaattcaccagtgaagccatcatctgctcccggactttcccttgtggtaatattttttattgctaaggcaatattgttgcttgttatagatctactcagattttctatttccctttgagtcaattttggtagtttatgtttttccaggatttcttaaattccatattgtttatcaaattactgattgtttgttggtgtacaattacaagaacaaatataagagaatcacaatttttttataatgctttgtattttctggggtctctaataacatccctacttacattttagtaatgtgaatctgttctattttttctttttcagcctaacttatggtttgactttaaaaagacatttcaaagaactaatgttctttttgtgtgtgatatctattgctttctcattctttatatcatttatttgtttgtttgtttctattaaaccttttctatttcctcccctctgcttgctttgagtttggtttgctcttcttagtctagtttatttaaatgaaatattgttattgatttaagatctcttttcttttttaatatagtcatgtgcaaatacaa

SEQ ID NO: 209 - DNA, 3001 bp, Homo Sapiens
  allele 1501: 99-26776-209 : polymorphic base G or T
  misc_binding 1481..1500: 99-26776-209.mis1,
  misc_binding 1502..1521: 99-26776-209.mis2,  complement
  primer_bind 1294..1314: upstream amplification primer
  primer_bind 1755..1775: downstream amplification primer, complement
  misc_binding 1489..1513: 99-26776-209  probe
agtaataatacatagaattactgagctcttgtaattttctaagcaaaataatagaagtaagaattagcatttatcacttcttatagattttcctacctaattctcatgtaataatattaagttattaatattgatactattgtcaccattttacataaaaaccaagtatagcccctaaaaggaaactaacttgcccagtaagtattgaaattattacccagcttgtatgtaaagagaaggtagcctgtggtcttcattattttgttacagcatctcccttgggcagcatctcattttggtttattaatgtggtagtaacttcaaaagaaatggattctttgatctctgattatatgcaatctggaagcaggtgttttatcagtcactaacaattgaagtgaatgcgttacatcagtaaagctaataatgtaataacatttacatcccaatgatcttacagcaatggttctcaaagtgtggttttcagatcagaagcatcagcattgttagagaacttgttagaaatgcaagttcctagacccatcacataacttttggcatttaaggattaaaatatgtatgtttactagtcctccaagtgattataatgcacattaaattttaagaaccacaatattcaagtataatttgatgaatttatacaatagatgcaaagccaactcaaacaaaaccatgtcctcttggtggcacaaagatgcaacaatcagatgagataaaaacacatcctttagccaatctggacactatccgccatggagcaaagcaggcaaacagaaaagtccaggataaattcctgcaagccagggtaaatactgccagtcaacaaagttgactatgtcaaggaagagaaaaccacatctactattagatgaggtcttaccatgtattatgcactgtattatatggatataaatccatttaaattaaataacaaatttacatggtggaatcaattattatccatattttctaaatcacaacactaggagccagtgttatgcctaattcacagagttagaaataaaaaatgatggaatttcaggccggatatgtttaaatctaaggcgcatgctcatgatcattgttcactgtagcctcccagacagtacttactgcagatgccagtgggcaaaattcaaattttggcaaaataacgaggcaacatcaaaggctctaggaatcagggttgaaattcctatattggccccctgctatgtttaatgccatccaccataaatgatgcaaaatgcagctcttttagtatcagttgtggccatccttcttgacactctccaaggcatcaattgtccatattacttctttatagctcatctacagtcatcagttcatgtccttctcctacctccagacagtcagaatctttccatcatcgataacatggatgacttcatcatctgacacctcactctgtattatttcttgctccagtcttgttcctagggaagtgtatattcgcatkactttcactttgcttgtattacttacactgcttaagtcattcctcccttgtctggctcagttaatatggtctctcttaaatgctatctctccatgaaatattcctctaccactattctcctatcttccttagaaaagttagtttcatctacctttgcaggttgtatttacaccagtgaatgattatttgccagtataaacctcctggactacaaactcaatcagggtacagatgaagacccaggctgtaatccctgcaaaaatcctggcacacagtaaatgctcaaagaaacaccccttggtagataggcaggcaatatatctatatattaatgaattaatttcttcctgatgcagaagagcaatcagtctcccctctgctatggaatgtgtgaaagcagaagtgaatctcatttaatgagtcacagtattcaatttcttagatttttcaatggtcttatactgatagtaaattttatatttctaagagaaataatgagtacatcttaaatttcttttttgatcttgttttctgaaagataatctacatataatttttcatttttagtaagcttagaataagagaactaagtatgttttaagtatgaaagtaaatcttatcaagcttagttgactggatgattgaaaaggacgaaaagtggtgaatcacaaaaaagacataaatgcacttttaatatttcatttgaagtcaaaacatgtaaacatatatgggtttgctcatcagttgatatgtgagtcagtatatggtatttaaagcttgttctctggaaccagatgtcctgagttcaaatcccatgaaagatactgagcagctctataacttagggaaattattcattttcttgcctctcaattttcttgcctctcaattttctcgtttgtaaaatttggaagaagaatattaaatgagttaattttataaagctcctagaaccctgtgtggctcatgctatatacatttgcaaaatgtatatatggtcccagtcactgcatggctataaaaatgcatctcaagggatttttgtaatggaaatgtcctgtgtcttgactgtattggtggacccacagatacacacatatgatgaaatttcataaacctaagcgcacccgtgcacatgcacacatacacacacatacacacatacacacgagtggctgggaaaccggtaaaatctgaatgagatcaacagactatttcaatctcatcctcattatgatcttgtactatagttgagcaaggtgataccactgggggcatatgggatctctctgtattgtttcttacaactgcacatgaatatgcaataatgtcaaaacaaaaggttaaaaataaatacatgggctattgatagtggtaagcatgtgtagggacagaggctatacagaaaccctgtaatttccactcagtttttctgtgaacctaaaactgctataaaatataaagtctactaaaacaaccaaacagtgtttatttttgttt

SEQ ID NO: 210 - DNA, 3001 bp, Homo Sapiens
  allele 1497: 99-26779-437 : polymorphic base G or C
  misc_binding 1477..1496: 99-26779-437.mis1,
  misc_binding 1498..1517: 99-26779-437.mis2,  complement
  primer_bind 1072..1089: upstream amplification primer
  primer_bind 1548..1568: downstream amplification primer, complement
  misc_binding 1485..1509: 99-26779-437  probe
atattagtggactatgtaccctaattaaaaggtagaaagtgtaagaatggattaaaaagcacgacccaaccatacgttacttataagcatgttttaaatgaaaagacacaaatagttgaaagcaaaataacaaaaatgtatatgctatggagaaactaagaagtatgttgatgtgtctggattactatcagacaaagtagatttatggaagagattgttggtagataaagaaggtcatttattgatgataaaagtatcaatttaagaaggcaaaataataaatgtttaaatactcagtagcaaagctctcaaatgaatgccaaaaaccccacaaaactaaaggaaactagagaaatctatgatcctagtgagaatctggcacagtttttccagtaaataatagaagaacttggaaaaacagtattagaaaaatgcaatatttgaataatgctatcatcaacttggtctaattactatttgtggaacgctaccctcatttgatgcagaatatacattttaaaaaattgcccttggaacattcactgagatagacaatatagttgaactatgaaagaaatcccaacaaacttaaaataattaaaattttacataataattctctccgatcacaatggttttaaattaaaatcactgatagtaattttcctagaaaattccaattgtcataaattaaacaatacattaggacatatctcagtcaaagaagaaaccacaagaaaaattagaaaaacttttaacagatctaactctacacttcttagaaaaatataaatacattaaaaataacaatattgaaaacggtatatcttgctaactctaagcaaaagaacattagtgaagctgtatttatgttggacaaagtagagttcagagtgataaaaaggggataaagatggtcatttctcattgataagggagtcaatttatgaaaagagcttaaacactcctaaaagtttatgacctaataacagaaagtcaaaatatattggagcccaaattgatggaactaaaaggtgaaatagaataacaattatatttgcagattccaggaccactcttcaatagtccattgagtaagtgaagagagagtcaagaaagatacagaaaactttgacccacttgacatttatagaatccaactctcaatttaggcaacatatacaaatggtcccagacttaacaatggttcaacttacatatttttgactttacaatgattttatcaagacgtaagcccatcgtaaatcaaggagcatctatactttctttttaagggcacataaaatatatacacatataagttgtgttttgagccataagacaagtgttcattaacataaatgaattcaaatccaccctttgatcaaatttaatgtaattagaaatcaataacaaaggtaaatgctgaaatcccaatatttagaaattaaattatatgcatctaaataactcatgaggcaaaaaatagagaattasatagtattttgaaatgaaagaaaatagaaccacaacacatgaaaacttgtgagatgcagataaagcagtattcagggagaaatttgttgcactactaccaataatacaattaaagacaggcctcaaatcaatgacttcagatactaccttaagaagttagaaaaataaagcaaagtaaacctaaagtaagtgaagaaataatgaggattagattagttattgaaataagtaaaatggaaaacaaaatcaacaaatctgattctttcagaagacccatgacttttataatcctctagccatactgaccaggaaaattacaagcgacactcacaagtagtttctacagtgtagatgagttgaatcattcctcaaaggacacaaattcacaaatttcaaaagcatgtgctcatcttaatggaatggagaaatgtctaatatctattacttgtgaaaactctgggtaaatgaaacaaattcagcttaacctgataaatgatatcttcaaaaactctacatccgaaatcatatataacaataaaagactaaatgtttttcctccaaggccaggaacaatctaaaaatgtccacttcaccacatctttctagctaaataagcttatttaatgttggtgggaactattaagttagttcagtaactttggaaaatgtaacatcaatatgtaagaaaaaagtatatttgtatatactagtaacaattaaatatgtaaattaaaaacataacatagaatagtagtaataatatataacatttgagacaaatatgatggaaaatggacaacacacttattctaaaacctatacaatatttctaatagaaattaaatacatggattcatatacataaatacacatatacagaaatggattacatacatacataaatgaataaatacatcttgtttatggttgaaagattaataatgctaaatgccaattctccctaaattactataggtttaatataaactcaatcaaaatcctagcagaattccttttgtcagagttggccagctcattctaaaatacatgttcaaaagcaagttacttggaatagtaaaaataaatttgaatataaaaatttcagtttagtatttgcagaacttgacttctagacttattataaagctacagtaatcactagaatggggtactggcatcaagagaagcaaatagacaataattgggagtccagattcaaacacatatagtcatttaatttttggcaaatatgcaagagtaatccagtcttttcaacaaatgtattggaacaattataatcttttcaacaaatgtattggaacaattatatacccatatgtaagaaaataaaattccacccatttaatgtaccatacacacacacgagtttggtaagttttaaaaagctgaagacataaatggacacttctcaaaagaagacatgcaagtggccaacaaacatatgaaaaaattctcaacatcactcagagaaatgcaaatcaaa

SEQ ID NO: 211 - DNA, 3001 bp, Homo Sapiens
  allele 1501: 99-26781-25 : polymorphic base G or T
  misc_binding 1482..1500: 99-26781-25.mis1
  misc_binding 1502..1521: 99-26781-25.mis2,  complement
  primer_bind 1477..1497: upstream amplification primer
  primer_bind 1905..1925: downstream amplification primer, complement
  misc_binding 1489..1513: 99-26781-25  probe
  misc_feature 21,274..275: n=a, g, c or t
atatgctcattgtgtttttgngtcgtcatagcttagctcccacttatccgtgagaacatacaataattgattttccattcttgagttacttcacctagaacagtggtctccaacagctgggcgtggtggctcacgcctgtaataccagcactttgggaggccgaggtgggcggataacgaggtcaggaaatcaagaccatcctggctaacaaggtgaaaccctgactctactaaaaatactaaaaaaaaaaaaaagaaaaagaaaaaaaaaaannttagccgggcatggtggcgggcgcctgtagccccagctactcgggaggctgaggtgggagaatggcgtgaacctgggaggcggagcttgcagtgagtcgagatcgcgccactgcactccagcctgggcaatacagcgagactccctctcaaaaaaaaaaaaaataataataatggtctccaactccatccacgttgctatgaatgtcattatttcattctttttcatggctaatattccacggtgtataaatactacattttcttcatccactttttggtcaatgggcatttaggctggttccatatttttgcaattgcgaattgcactgctataaacatgcatgtgcaagtgtctttttcatataataacttattttcctctgggtagttacccagaagcaagattgctggatcaaatggtagttctacttttggttatttaaggaatctccatactgtttttcacagtagttgcactaggtttcttgtttctttgtttttggttttgttgtttttgttttgagcctcactctgttgcccaggctagagtgcagtagcatgatcttggcttactgcaacctctgcctcctgggttcaagtgattttcctgcctcagcttcctgagtagctgggattacagacacccatcaccacgcctggctaatttttgtatttttggtagagatgaggttttgccatattggccaggctagtctcgaactcctgacctcaagtgatctgcccatcttagcctcccacagtgctgggattgcaggcatgagccaccgtgcctgcctgtggttgtacttgtttacattcccatcagcagtgtagaagtgctccctttccacaccatccatccaacatcaattttttttttgattgtggccattctcacaggagtaaagtggtatctcattgtggttttaactttcgttttcctgataatttgtgacattgagcattttttcatgtttcttgaccatttgtatatcttcttttgagagttgtctcttcatgtcctttgcccactttttgagcaaagtaagcagacaacccacagagtgagagaaaatatttgcaaactatgtatctgacaaaggactaatatccataatctacaaggaacacaaacaaatcagcaagatcattttttttccatgtgtcttctttctcagctcatttcttgtaccacatgcgccatagtaaggagaaagtatcttgktatgtacaatttactgttatagtaatttggtgattaaaaagcacttaatgaaataattctaaattgttatataaaaaactaaaaatcagcaggcagaggccctcctgactgccttaattcaactgtacaattgtataaatcattaaattcccaggagtctcattttctcatgtataaaatggtggagatggaaaaaatgactcttaaggtcattgccagatctgatatactctgattacatcccaggctgatggtaacaaaaacacatgtggaaaatatagggctgaaaggactttgccaagtagttgattactacgacatgcatcctcactgctgttactagaacaagattagtactatttgtatcttgtttcagtgtttttcaaactttgtttctcctctaggtcacttgaaatgagcaaaattccatcattagcaatctttttatgtgatgctagagagattattctcccgctctcccaaatatttcattgtgtctttttcccaaatctcaaaaaaaaaaaaaaaaaaaaagaattctctcatctctcactcataacagataacttcggtttttaattcccctggaaatgcaaaggaatctgataggaactccatcaatatctcatccttaaaactctgagcctttcttcttcagtgcccgtattctttttctcgagttgcagtggaggccacattgcctttgggaaaataccatcatcccactcacactccagatggactgcttcttatcagggttactcaagtttttgcctcattcttctactggttgttatttaaaatatttaccaaatggttatgacacaagcatagatcacagaagaggaagtcagcactgaaaaccagtcctgctctttggaatcaccccttcctctctctcgctccctctcatcatatccatctgcctaacacggtgcttgacaacttcccaccttaagaaaacacttccttggcaccctgggcttctttgcctgccatccagtttcagggcactaaaaaatacaattgccaatatgggatgcaataaagagcaaatggcaagtgaagaagtggagataataagataccaatattcatttgagtagattttcttctaaaaggaatcgttgggtcacacaggctccatttcacactccctcttactgctcttatcaaatcatcagtgacctcatccttgcccctttcagtggatactcttctgtcattgatcctacttacttcttcatagcagtttctcctctcttgctcagcattttgttacaacatgctctatttgtgttgtcttcttcaccagctgcttccaagcttcctttcctgtctcctacaacttccaaaaaaccttaaagttttaaggtgccacaaagcttagggcacaataccttatctattgaaaaactctatgtgatctcatccttttctgcagtttaaaatggcaatcgcacactgacaattaccagatttctctctctgacatttatc

SEQ ID NO: 212 - DNA, 3001 bp, Homo Sapiens
  allele 1501: 99-26782-300 : polymorphic base A or G
  misc_binding 1482..1500: 99-26782-300.mis1
  misc_binding 1502..1521: 99-26782-300.mis2,  complement
  primer_bind 1202..1221: upstream amplification primer
  primer_bind 1695..1715: downstream amplification primer, complement
  misc_binding 1489..1513: 99-26782-300  probe
aactaaaaatcagcaggcagaggccctcctgactgccttaattcaactgtacaattgtataaatcattaaattcccaggagtctcattttctcatgtataaaatggtggagatggaaaaaatgactcttaaggtcattgccagatctgatatactctgattacatcccaggctgatggtaacaaaaacacatgtggaaaatatagggctgaaaggactttgccaagtagttgattactacgacatgcatcctcactgctgttactagaacaagattagtactatttgtatcttgtttcagtgtttttcaaactttgtttctcctctaggtcacttgaaatgagcaaaattccatcattagcaatctttttatgtgatgctagagagattattctcccgctctcccaaatatttcattgtgtctttttcccaaatctcaaaaaaaaaaaaaaaaaaaaagaattctctcatctctcactcataacagataacttcggtttttaattcccctggaaatgcaaaggaatctgataggaactccatcaatatctcatccttaaaactctgagcctttcttcttcagtgcccgtattctttttctcgagttgcagtggaggccacattgcctttgggaaaataccatcatcccactcacactccagatggactgcttcttatcagggttactcaagtttttgcctcattcttctactggttgttatttaaaatatttaccaaatggttatgacacaagcatagatcacagaagaggaagtcagcactgaaaaccagtcctgctctttggaatcaccccttcctctctctcgctccctctcatcatatccatctgcctaacacggtgcttgacaacttcccaccttaagaaaacacttccttggcaccctgggcttctttgcctgccatccagtttcagggcactaaaaaatacaattgccaatatgggatgcaataaagagcaaatggcaagtgaagaagtggagataataagataccaatattcatttgagtagattttcttctaaaaggaatcgttgggtcacacaggctccatttcacactccctcttactgctcttatcaaatcatcagtgacctcatccttgcccctttcagtggatactcttctgtcattgatcctacttacttcttcatagcagtttctcctctcttgctcagcattttgttacaacatgctctatttgtgttgtcttcttcaccagctgcttccaagcttcctttcctgtctcctacaacttccaaaaaaccttaaagttttaaggtgccacaaagcttagggcacaataccttatctattgaaaaactctatgtgatctcatccttttctgcagtttaaaatggcaatcgcacactgacaattaccagatttctctctctgacatttatccatcctctcaacgctgaacacatatcccagttgacatctccactgaggagtttcacagatgggtcaaatgtaacatrtccaaaacagacctcttgtcctcctctgtgtacgcccttcttactttcattttaaactcagttctggataatattatttacccaaattcccaaagcaaaatatttgaatcaaacaatcttgtcctcctcctccctagccaatatattagcaagtatggccaagtcttcctcacctatatttttcaaaatccatccatacctctctttcttcaatgccatatgtcctattgcatttaaccctttactggtctactgactagctatattactccattttcctactgctttgaagaaatacccaagactgggtaatttataaagaaaaacaggtttaacagactcacagttccacatggctgaggaggcctcacaattatgatggcagaaggcaaagggggagcaaaggcacgtcttacatggcagcaggcaagataacatgtgcaggaaacttctcctttataaaactatgagatctcatgagactttttcactatcacaagaacagtgcagggtgcggggaacctgccccatggttcaattacctcctaccgggtccctcccacaacacgtggggattatgagagctacaattcgagatgagatttgggtgaggacacggccaaaacatatcactagcttcttattttacagatctcatcttgagtgtcgtcttctcaggattttctttcttgagtactctactcaaggtaactccaccccagcaaacccaaagtccacacagttggcagctccctgctgtgtggttcagtgcatttcactgtacttcacaccatcaaaatgtgacatcctttgtgtgggcctgtgtattatctgctttcaccttctaaagtgtcagctacatgaaagcaagtatctaatcaataaaaacatccttaataaataaatcagtagtaataactatcttctagctaaatctaaatgggggagaggggacctagccctctaccttcccgtcaattgcttcatactcatataatactttaaagttttaaaagtactgtattattactgttaaatctgatcataaataatccttcaaagttagtgagatccaaataaatatatgctatgcacatggtcaaaaccagtatctaaagttaagtgacctttcgaatatcatacaataaacattttgttttaacagtaccagaatttgagctctctaatttttcttacttgggtattgtttatagaaaagtcttagtttcttgaaaaaaactaaacatgcatttgtaaattgtttaatgtatttataggtaaaattatttttcctgtgactaaacatattaaatatgattatctagtatcagtttattctgtatgactatatatatgggatatatatatcattttgttattgacactaaattggttatgtaaataatataaatgtgggataatttattcttttaaataattttatttaaaaattaatcgagtttaaaaataataagaaaatggaatttttaacatttttag

SEQ ID NO: 213 - DNA, 3001 bp, Homo Sapiens
  allele 1501: 99-26783-81 : polymorphic base A or T
  misc_binding 1481..1500: 99-26783-81.mis1,
  misc_binding 1502..1521: 99-26783-81.mis2,  complement
  primer_bind 1421..1440: upstream amplification primer
  primer_bind 1857..1877: downstream amplification primer, complement
  misc_binding 1489..1513: 99-26783-81  probe
  misc_feature 2988..2989: n=a, g, c or t
gaaaatggaatttttaacatttttagtcttcccaaaggaaaaaaaaataacagatgtaagaataagagtgtcattatttaagttatatatgatgtcatgacatctaagcaaaaataaatgaaaactgtatagactatcaagactatcaacactaaagaaaaccttgaatttgcacgaaagacaagacctgaatgtaagagacaggttcagtagaaaaagaagtgtctaatatcaagtcagaatgacaggaggggccctatcctgtatttaaatgctgaaaggtgtaacaatgtacataatgatctacatgaatcacacaggtcaaaggatgcagtgccacagaaagactgctgaagaatgctgatagagacgtggttagggcagggagaaagtagcaaactaagataaggcaagtgccaaccctattgtgtaacacaaagcagccctttaattttaactaaaaataatttaagatttgtcaccttaatttggatgatatatttattgtgataacaatcatcttgtcacggaatggttaaatttacctagattttcaatttaaataagagttggtaggaaacatctcacattgaaaatatctgtttcacagcatttggtatgaattgtgcttagaacaattagaaaagaggttgctattgatgcaaatatataggaatatttgtaaaaattatattacaaaagctagtcaagaaatcaaattacactgcctcttccagtgccatttctgtgggaaagtgtggctatgtgtctaagcactgtgaaagtcatatcacattatacaatgaattaggagaccttagcattcattcatcctcaccgtgagctgctttgttgagcgcttttgcatctccacattaaccaattgggaaaataattgcattaacatagatagttgtactggagggaaaggaaaaatattcttttcttctacacaatgttattttgtaaacaaactctacagtgataaaaaggccccaggaccaaactgaagattagctagaacacattctaggagcatgattccaattattgtgatgaagctgacctatgtatcaaagtgcttgatagtagaaacttcattatataagacagactaagctaatgtgcaaacaaagaaatattggaaaaatgtaacaaattcaatgaaatgtcaatgcatagcacgaatctattaaagggaaatctccttttggcagaaacaaaggtaaatcactattgagaacactcagtgggagacaggacaaaggggttcatgggaaatatgtaaaataggaatgagacggaagttttccattttgggaactggagtttcaatttctataggaggatgagacctgggctgtgacctgctgttggtgagagtatgaaactgatcaactttcatgaacctaggagttaggcttaaaggattgctaattcaaataagaattatacaaattttgcacataatctctgaaaggctttctatccacttgcatawtacttcatgtctagagcctacacatgattgtttcgggactaatacaaacatattggatttagagattcttgagcatggaagatagaaataatatggtagaactagaagaagcaagtttccctaatgacctggtggagcaatctgaattgccacctatagaattctttcacttgtgaaaataaacaaagatatgtttaaagcactggattcaagtctttgctcctggaagccacaagtaactgctaactgataaactgatctggcgccaaaaaaattgatcccaaacataattagaaaaacagatttcttcaatgggccaccccataattatttatggtctgatatgatatttgctctcttttgatagttgaatgtgttaacttttttaaaagtcatgcaaaatatttcatacaatgcttaataagttacattatcacaaatgttcagtataatattagatttccctttcttaacttgtgaaaaagcactttagtcacagagaagctcgaaaggtagatacagatacttaaaaaagtaaaattgtaaaaggagctgtaaaaattttctttaaattatgacagctaaaaaacccatctcgtatcccattttagaagaagtattttaagcatcagaagcaacacacaaaatggtttgaaggaaatagagacaagatagacggtgtctaaaaaaagcatgaagtgattattgcagaattcaccttattgctaattatatgatgaggtgggaaatccaaatagctcctttgtgcacagactgcagattttctagaacatttagtaaaatataaaaatagtttttttttttaagtttagtttcccaatgctgatcagacaatgacctctattactgtttggaacaacaaaaaaaaaaagtctgacagcttatgagtgaagtctacaagtcactaaaaccctaaaaagagcatctcatgagaagtctataattgcactctgggaagtttaaaaactctagtgatgtttttaagaaaatagacctttttgtatatcttagatcttaccaacttggctactaattttggtctgcttgcacaccaagctagacaagcagttaattgcacttaaattgacattttgattgattcaaatggtattcctgatgaattttactatgttgtaaagaaagaagttcagaatgctcaataagaaaggcttggggaaagcttttgatgtttaaattttagagttgagaaaattaagaaccaaataaattaagtgacttcatactcggttaatcagtaaaacaaactagaattagacccaaggctcctaaatgctctggccagctttctcctggtggatgacacatggtaatacagatcatttgataggccaagaaaactaccaatatactcatattgatggaatctctgtctcttgcatgcccccttctgataaaggctaatacatctataccaaaaaaaaaaaaaaaaaaaaaaaaaaaaaacnntatttaagagag

SEQ ID NO: 214 - DNA, 3001 bp, Homo Sapiens
  allele 1501: 99-26787-96 : polymorphic base A or G
  misc_binding 1482..1500: 99-26787-96.mis1
  misc_binding 1502..1521: 99-26787-96.mis2,  complement
  primer_bind 1406..1425: upstream amplification primer
  primer_bind 1872..1892: downstream amplification primer, complement
  misc_binding 1489..1513: 99-26787-96  probe
  misc_feature 2873: n=a, g, c or t
cacgacgatctctcacacacagaccaggaacaagaagtagcgaggctaacagaaaagaaccgcacatgaagttggatttcaagttacagttcaagatgggactaaacacagtagtgtttcatttgtatgatattctgaatgctgcttcttaacacacatgcaatttaattttaatgggtattttactgtgattaataaatgtcaattctctgtgttatcttcgcatcataacatattcatagactttatctatgccaagagtacttttattgaacttcatgttctagagaattggggtgctgttaacaatagtttcacagtttatgtgttttgtaaagctcaatctttaatgaaaatgctttgtgaactcacagacctgtttccttgataataaaagagtaaagaaacatagaaagggcatggatagtgcagatgtcacatactggataaattaactttaagatttgttaatggaaatacaattttttaatacaatgaaggatgattcaggctggctaatttaatcagacttgtttttttcaaattcatatcacctaaactttatccagaataacttatacagaataccattaaagcctactgcttctaggaggtagatactattacttctaatgagtgtagaaaggttatttttgggcaattaattttaaacataaacatttctcattttaacattcgcctttcattctagacttagaagaagaagccattatgtaaatgctgccgtggaggacccttccctccacttattcagaacctcaaggtccaattgatctgtgatagcgttgctgacaagttcagtcactattgagcatcactgctctccaatccccagagcacttctccttcatattaatagagtgcgtcttagttataaagccctttcacacatgtgcacgcgttaccttcatcccaaactatagagtaggctgttttttctcttcattttgtaccttttgaaactgggacttcactcacaactgtagttcagtaagtgatacagttgggtaagacaaaggactactcgcacccaaccttctggcttcatgtctagcctacatcacacacagtggcactcaactgtgcattattcttgtttgtgtgcacttcttgtacatatatgattggaattccaaaaaaagtagacattttagggtgcagactcaaacctttctagtagctcctatagcacctggtacaatctgaggcatcatggaacatagtatgaatttaaactaaaattcaattcaccaacataaaccgttcattgactgcatttttaaagcagggtgcaaagaaaaaagatttcaaatgtgagggacgaaaatactcaggcatgagaatagttgggagaggtagtcctccattttagcgtctggtaaaggtcaggttttttgaaagcagattttaaggtggagatttgcattcgggaaatatgttgagtgctctcactcagcaggatcttctctggggtgaaggrtgaagaaggcaggacagggcagagggagacgctggaccgtgagccctcagccaattgtctggagagctctggagttggatggccctctaagttctcccaacttggacaaaggacatgggtatataccgcaatttcaggagtccttggagtgacactgtccagcctcctgaaagggaaccttaggtgaggctgctctcttcaaatgaagggaattctcagagaaggccgaggactgacggcttgccacccagcgccactaccagcagcttgtagaaaaaaatattttaaatggggaatacatgcagcacaacatagaattcaccactccaagaaaaaggaagaagtgaggattgtattatctctctctcaagtgaagcattgctgtagtaagtctatagaaaacatgcatacatgtgtaactgctgtcttgagcatttctgtactgagcactttatagagattattttcattaatctttacaaaagccttagaaggcaatcactattgttattttctttttacaaatgaggaaagatgcttggcgtatctgagaaggtgataaaggccggagggctgaagtgcagacagggatggagagagtgggacggggcatggaggtgaggtagaaggaggtcctgtagtgggggcctgatggggctcagaacaggttgaaaatgttaccaataaacatgtgagccagcaaagatttacaatttctgattgtgtgtgtttctacccctccctacccattgtgtttgtaatttcaattacagacatttcaaagcagcctatcttcatttgaataagatgtgggtatcagcgaacttttaggcaaagagggagcaaaatcaaaaatgtcaaacttgaaataaaaataattagtaatataattttttaatttaaaaaatccatctccaatttgaaacagtcttactatgcctcgtacaagttagtatttctgttgcaaatagattcaagaagatagaaaaagcactaaatggataaattggagagggaaattattttgttttcttcctattaatggataggaagtaattatacaactaagatgatactttttcttattatccatcaaggaacttgggacccacaacccatttgttttctttaagcagaattatgaatcatagagtaaaatttttctgccaagtcttagtaggacacttttctttccttacccataaatttaatcactcagaatgtactagtgtttataccaaatatctccattgttaaatcttggtataagtttttaccatcttcctcctacattattgcaatattcttctaattatctccttgcttctggtcttgcctccatacaatttattctattcacaggaacaaaagntttttgtttttttttttttgagtcaaactctcactctgtctcttaggttggagtacagtggcacgatctcggtcactgcaacctctgccttccctggtcaaacaattctcttgcctcagcctcctgag

SEQ ID NO: 215 - DNA, 3001 bp, Homo Sapiens
  allele 1501: 99-26789-201 : polymorphic base C or T
  misc_binding 1482..1500: 99-26789-201.mis1
  misc_binding 1502..1521: 99-26789-201.mis2,  complement
  primer_bind 1301..1319: upstream amplification primer
  primer_bind 1771..1791: downstream amplification primer, complement
  misc_binding 1489..1513: 99-26789-201  probe
taatcgccatgtgtcagagagagatctcttgggaagtgattggatcatggggacagatttcttcctggctgttctcatgatagtgagggttctcattctcacaagatctaatggtttttttaaacgtgtgttgcacttcccccttcacctctctctcctgacaccatgtgaagaagatccttgcttcccctttgtctaacaccatgatggtaagcttcctgaggcctcccagtcatgcttcctgttaagcctgtggaactgtaagtcaattaaacctcttttcctcataaattacccagtctcaggtagttccttatagcagtgtgaaaatggactaagacatgtctgatgtgtaattgttgaataagaaatgggtgtgcatgcatgcacacacacacacacacacacacctgtgtcaaatgaaaaaatgaaatctgtagcatgcagactgcctaaaatgcttgaaaaaatagaaagattttcccaaagccagcacaacttgaaaatttcctgaagttaacccatcaaacttaattccttctgatttcctctggaccctttcgaatgggaacttctcggttcttctaaaattatatgggcccaattgctgagccgtatatttctcagggactagtatattatctaaaaattcagcagaaattatatatatatatatatatatatatatatatatatatgtgtgtgtgtgtgtgtgtgtgtgtgtgtgtgtgtgtgtgtttgtgtgtgtgtgtttgtgcagtatggtgtttgtatataattattacttgtaaaaacaaaattaaattattacatatggtttcctccagctttggatcacttcaaagagtattaatgaatggttaatgcattagcaaagtgattctgacttttgacaaactaaaaatggtattcagctaaatctttcaaaatgagtggtttaagaaaggttttcacaactaaaaatatttttaatgtaagacttgagtagttcttaaggaattgtttagatgagctcaaatgcatgccgttaaaacaatggaatgttgcaatcacaaatctaacattgtaggagagagaaaaaaagccaaccaccagaaaattccaaaatatttcagttaggataattaatccaaattctgtttagacctagtgttaatctactcatgaaaacagcttattaaatggaattcaaccatcacaataaagaaatcattgtgcaattaattactcgtagattttgtggtgaaaatttcacttatgaaagaaacaacatttgctataatgaagctaaaagataattaaaatcaactggcatagagggccaccgtgccatactgttttctcaaataacttgaaccataattaaatatttaggtgtgatattttaattgttgacattgatttataaatagtattataatgtgtgggaaatctgtgctgcttattcagctttcttcattggttgtatttttaaaagttcaactgttgtgactggctatayagagcaagagttaaatgttgccccaaatgaaagtttaattagaaatattctaacctgttgataatatattctgagtcccaaatgcaagtcacttttattcagcgaaagatactttatacaccatgtcattccattctaagtattagaaacaagacttcttttctgtctcttagtgatgggtcaaaaaataatatgagtgttatttaatcctattttttaaaaaattaaaaaattggcccctcattgctagaagaggttgtatatatactgactaaagacattgactgtagctttacagactaaaactttatggtatcaagctctcttgatgtgttttttcatgatgcagttaattggagggtggcagttagttttggattaagaatactttaaacctacctgacactggtttctataatttacaataatatcagttttgattctcacttccaagtttccatttttattgatgactgacttgttctttgtttgataaaatgaatttgtacatttgacctaaaatagacacatttttgttctttcaaatgagagtaacgttttattttttctgcaatatttatctatggatatattgccatttattgtccttttatacttcagttacctgaagttgatatttctaaacaaatgtataagccacaacacagattatcaagtcccttcttttttgtatatgaatttgcatgttatatatatcttatttattatatatgcatgattatatatatttataatgatatagtcacacttatgagaaacagaaaataaatcacctagtatagaaattacacatagctccagtattaatattgtagtatttacatatatatgtttactgttataaatttaggtatagcaaagttataagtagcaatataatggatatctacattattatattaatcggtatgaacaaatcaggccatgcgtatccctcccattctattgtgctcacattttaagattattattcaaaaaaggtttattaatgtgaaaagtaaacatactactctcaaacctttctgaaacttctgaattaaagctatttacttgctctgggactttaagatatatattctattaaatacatgtagtttataatatccaacctcattatttttataactagagatgacctggtggacttaaaaagtgaaaaggatataataaaaaaacattagagaccaacaagccatgtttgaacttgacatttgcgtgttttctattcacagtacctggatctttgtgtgtctataacagaagaatatgactgggcttggatatatgtaggatggttaacaaaaaaagaagaatgaagaacaagaaatttttagggacactcatgcggttttttagtggtgtagtctgagccctctgcctctgtatacacatcaattgagcaaaacaacctgtcttcccaaaacatgttagtgaaatactgcaaaaaaaaaaaaaggccttcactaatttagcacgttg

SEQ ID NO: 216 - DNA, 3001 bp, Homo Sapiens
  allele 1501: 99-27297-280 : polymorphic base T or C
  misc_binding 1481..1500: 99-27297-280.mis1,
  misc_binding 1502..1521: 99-27297-280.mis2,  complement
  primer_bind 1761..1779: upstream amplification primer, complement
  primer_bind 1206..1224: downstream amplification primer
  misc_binding 1489..1513: 99-27297-280  probe
gaatgtatgtgtattccatttgattgaagaaagttgaaaatgcatacgactatttatcacacactaagaacttcctggtatcttggatgtggaatgagaaatcaaaaatttatgaccccaactttgtcatgtactcactgcataacattgaccaaattacctatcctctctaagccgtaacttctacatcactagtacatttcatgaagttgtgagagtcaaatacaatgatttatatgaaggacttagtaattaaacaagagacatcatatttagaagtcagtcatttttaatatagtaaacaccttcagtcaatagatgctttctaccattctttttaaataatttaaaataacattgtacaggattgacttttcatgccaggctttgtttctgcaatgtggtaattcatattaatgattcattttcctgatttcaaaatatgaaatttatcttttaacttctccgtctctccttcttagcccatatgtcaataatgactgaaagtaatcatttccatctttaaactgcctattccagccccctcccacctccatctctttccttctaagttttcttcatcttctactttgggcaaaaggaaattgatgtgtcagacaggcctagttttgaattctggatctgctagcacttctctgtgtgtccttggttatatgatatagtcttaaaccttaatgttcttgcctgtaaaatggggataataaaaacctcttaacagtggttgtttcatgcagctttcattacaaacttcctcattcaaaatcttcaatgatttccatttttcacaaaatgaaattcaaaatttctgtagattattgagacaagtcccctactcttcacctaaatttatcttttatttattctctcatcattatcaacaactactaggctttgttgccttgactccagaggcaaaaatcttatctcccaacaatgtctcttaagttaagtgtaattcattatttgatattcttgtttcaaaatgggtagaggaaaacttcctgcatataccgtaaaataattttagggaaaatatactaatgtatgttccagagcactggaaggtccaaagctacctatttgcattgtaccattactatttgatgtagccttttgctcattatgcaatgagctgaaatacatttttcatcatgcctcctgagtctctaagtaagagtgattgactcattccttttctaccagtgagattgcaaagcaaaaagaaatatgtagtatttatttactcatggaattcattcttatgaaggtcagttgccaaatgatgccaaaaccttactttctagaatgctattcaagttatcaggctttaacgttttcaagatgtttatgtttgacaaccatatataacataaaattatgtgaagtaaagtataacataactgtttcttttctatgaaacatgcctatttcaagtacatagtacactgcactgcagataaccggctgataaccagctctyaacacatacaacctaatgattgaattaaaccatagtgtatatttttctaaatgtattcttaattaatcacattacaaccatcagtatttgggtgaacagcttcagcatccattagtttttgagcaaagaactagaattcggagcattcaaatgatactagagaaaagacatgaagactgtttatgagattggtccatctctgagaaatgtcaagatttaagaagagccgcaatttcaaaaccagggctacttcattgtggacctgaatctatttacccagggtcaaatcaaggatttggaacagaccatgggaacacaccactttcaatttttgaaatatttgcaaatacatgatgagatatcttggggatggaacccaagtctaaacagaaaatcaatgtatgtttcgtatctaccttatagacatagtctgaaggtaattttagataatatttttaatattttgtttgacaccaacattattcctgtctctgaatttatatgctacacataagcaatcattttattatacctattcacatgtaagtacttaacagttaaaaattgacataccattcatgcaataaaaaataatatgctgaaggtaactaagcagtatagcagcagcatcacaataaacaagctgttacaaaatagcaataacaaacaaaggaaggcttccagtctccacctacgagtctgtattttaatttaaaagttactgtacgctgtattattattattttatttgagaagaaacatcagaagcagtcgagggattaggaagtgggtcctctggggaagaggacatattcggctggatggcttctaaagtgtttcctccagtcatctgcctcattaacaatattttttcttacaagcctctctttgattttataaactgacatgatttcttgctctatgaatccatgctgctccagtccttcaataagctgattaaacattttcattatgtcttctgtaggcactttctctgcagggttaacaatgtcatcttcattgccactattatcatgatcaccttgattctgaaccattttggctatttctccatcagtcaatgagtgaacaactgagccttaatatcaataacgtctataacattcttcaatgttcacttcatccagtttactgagggactctgaaggtatattttttgcatatgtaaagaggtcagacaacattttattctcacttgatacacagaatccctcaaagtcaccaccttattaatcctcatcactgagcatagttgcagacccagagggtatgctagacatgcatagctatgtatttagttcctgtgttccaagccttggcaaaagccaaaacagcatccttcatgctaagttcctttttagaaactttcatatttataccactattcactgatgctagctagcatggtattcaagaaagtattttttatattaattttcattgatctaaggatacctttgtcacacagctgaattaata

SEQ ID NO: 217 - DNA, 3001 bp, Homo Sapiens
  allele 1501: 99-27306-108 : polymorphic base C or T
  misc_binding 1481..1500: 99-27306-108.mis1,
  misc_binding 1502..1521: 99-27306-108.mis2,  complement
  primer_bind 1395..1415: upstream amplification primer
  primer_bind 1822..1842: downstream amplification primer, complement
  misc_binding 1489..1513: 99-27306-108  probe
aggcactcatagccacttgtaaattgtaagagttaagaaggcctttgcctctttattcaggaggtgctcgaaggaaatctggcttcttgtgagtttcctggaagttaggctttgactgtacaatgggaggaagggagtacatttatcttaatttttatttatttctccttaatgccttttaaatgatgttttaaaacaaaacgtacttatatttccattatacaaataaagaaaggcacattcttgtctcatgctttatagggcggcttcagagctgcagttttcagactagttgatctttatgttctaaaaaaattattgggtattccaaagaccttttgattttgtagttatattgatcaatatttaccatattagaaattaaatcatccaaaaaattttaagttgtttgtttattaaaatgacaacacaatgtgcattacgtgataacatattagtttcattaaaataactatattttccacaacctaaaagcaggtgagaagaaatggcgttgcttaatatttttgcctatctctttaatgactcacctaataaaataaagctttattttcatgtcagctttttcattcaatatatcacaattcattgttttgtttaaggtatatgaaaaaaatggcaagcctcacagagatatggataatggttgaaaaagcctttgcagataactatggatatcctttgttcttcatacgacccgaaagctttacaaatggatttttaaagtttcttgtgatgtgtaatctgaaacgatatgaatacacttttgtactcttttttaatgaaaaggcactaatctatcttgcacttcgaataaatattttactcaccaatgattttatagcatcatgcattggtcatttggagaatattgattttctgacatataaatcttccaaacattggcataatttattatctaatataagacatatcacattcaagtattcggaaactgtgaaactttgcttgatagataagttttccaaatttctacttaatccttgaaagcttgagtttgctactggcaatagctactgtccgttgttttcccgaagtgactggctcacttcattcatttttgaggaagtctgccaaatgcccaaatgtggtgaaacttcatttctgtcagttgttctttcaagtagaagtggtgttccctaaaaaggaagaagctagttcagctcacagctccaacaatgcatgggtgcttctcctcaagaaaaccatcacatgctgtaggggctgacattctttcagaaaaggagacatgccaataaggctcaagatttaattacatgactaagttgtgtgacttcctcaggacattcattctcatgggaatctgaagttttattttttcccaggagtgtgaagtggtgaagacacgatagatgttagcacactcagagctatggcctcggcttctactgtggtaccatcccgtaaatatccacagtgaaaaaggatgacgacgtcytaaccatgccctgtgttttttaggaacactgtttactattatggaccctttgaaagctttgtgagcaccctctaagggtccgaaatcccacttcgagaaccacagccaatgagcaatggaaacgtgaacacagaagagccatatatttttaagactccttcagataaatctcactccccacccaacccactaagactctatccctgccttttaaccatccctgctatgatgggaaggataaggaactatactgatttacttttctatccaaattgtaatagtgggattggaaagagtaacttttcttctccactatactcccctagaacaagctcagtcagccacattgatgtacttgttatttttgtaaagtaagttgtagactctgacccgacaccaacaccacacccaatgtagagttctaagactttacatttattaaaaaatataatcctattatcgctacatctattaaaatttagtaaaaatatgtaatcctagtattgcttcttggaaaagttgtggcaatttaatgaaatcacagatgcaaacctgtaatgcagtggctgaaacgcatctggaagattctcctctgcagtggctgaaacacatctggaagattcttcttcttctcctttttctttcttcactttccctagaggtgagcacagtgactgacatataacagcagattgggatgcaataaatgtgtatacaataagttacttactatattgtatattaataacagggatgcaataaatatgtatacaataagttacttattttttccagctttatagaagtatactagacaaataagattagtatacattcaaggtgtgcaacatgatattttgatatacatatatcaaatgtggaatgattaccagaatcaaattagttaacatatccatcactacaattagttaacatttgcatgtgtgtgtgtgtttgtgtgtgtgagataaggatacttaagacccatctctcagcaaattataactgagcaatacagaaacattaactgaaatcacaatgctgtatattaaattcccaaccaataggtgatttctgagtgcatttgggtcacagcttttccacatcttattttcacatcctttttgttgtaaaaagatggggacttcttggaatttggcaattttgctttttgttttttatttaaaaaaaaaagttgttactggaataatgacccattatattctaaagttcatgacctggactttatttttggtgtcaactatacttaggcattattagacacaaatagaacaaagaatcataaatatatttaccaaaaaatagctaaaaaatcaaaataatagtttctgtacaggatgacacatttccctgtgctaacagattttatatgttcttattataaacttatttttgaaatattttctgtgaaagccattctgacattttcaatacttcagaagccagaataattctgtgtgtatttttcacttaaatagt

SEQ ID NO: 218 - DNA, 3001 bp, Homo Sapiens
  allele 1501: 99-27312-58 : polymorphic base A or C
  misc_binding 1481..1500: 99-27312-58.mis1,
  misc_binding 1502..1521: 99-27312-58.mis2,  complement
  primer_bind 1445..1463: upstream amplification primer
  primer_bind 1940..1960: downstream amplification primer, complement
  misc_binding 1489..1513: 99-27312-58  probe
  misc_feature 83,95,495: n=a, g, c or t
atcctcctgcctcagcctctcaagtagttgggaccacaggtgtgtgtcaccatgcctggctgatttttcttttcgtttctttntctttaactttntttttttttttttttgaggcagagtcttgctctgttgcccaggctggagtgcagtggcgcgatcttggctcactgcaagctctgcctcctgggtgcacgccattctcctgcctcagcctcccgagtagctgggactacaggcacccgccaccacgcccagctaattttttgtgttttttaatagagagagatggggtttcaccgtgtttgctaggatggtctcgatctcctgaccttgtgatccacccgccttggcctcccaaattgttgagattacaggtgtgagccaccgggcccggctgtctggctgattttttaaagtttttgtagagatggtgtctccatatagcacccaggctggtcttaaactcctgggctcaagtgatccacctgcctcagnccttccaaattgctgggatgacaagtgtaagtcaccgctccacttccatatcttgcctgaactattaaaatacctgttatctggccttccactcagcatttaatccttctctgtgatctccatctggcagccaaataaacttttaaaaccacataaaatctatcctgacattctcatgcttaaaatcttcaggtagcttgtcatcagtctcagaaataattaaaaatcctgtcccttgctgactaaacacaacttgctctcaccctgtctcataacagtctcttttttgccttctgaacgttacaatgaaatgaatctatcatgccaaattattgtataactgtattttctacgtctaaccaagaaccagtgagcctgagttaagaacagcctgactcgtttgggaaatacattatctttgtatagaaagaccatagtgtcctcacttgtattttgtctgaggagactaaaaatggctgtgttccatccaccatgcacccctcactgcattttaggtgttcagattatgtgagatactttgcaagttacaatgacctttcagaattaatgatttgttcccattcactgaagcaagcaaacactccagaacccctttttcataaaccgccctggacagaaggctttctgatccaataatagactcagtcaggctcttcagaaagtagagaggaaatcaaaatctacccagtggaacaatccactactgaaaggcagttatcccttcaactcacatgcagatttttattatgttaaaggaaataaaacaaatattaacagctgtttttaaaatgtctactaatatgtaaggcattagtcaaacaactttatgtacaattcttcaggatccacagaaagtcggcagcttattacctgaattataatgttctatcaatattagctactgtcataaaaaattattcacaacatcactgttacgatgtgatctccacattttacagagagaaatgtgatctccacattttgmggagaggaaatggaagcttaaatggtaagatcacttatttttgttcagaagtttgataatcagcagatctagcatttaaactaaattgtactggctccagagtactaactgtggtcacaccacagtggccttaatttaaaatttcccactcctctttaccttgcaaagatgcttaccgaaggtgcttacgagcctttgtctttctgtatatgtgagattctcccctttgtgctgccagctcctgaagcttaaatatcctgacattttcagaattggtcattgccacttaaaatggggcccaatgcacagtgtgctcaataagcatttgatgcaggaaataacgaaaatgctggcatgtagcaggcatttcacagtgggccacaggagaatgaatgatattcgctgctgcacagtggtacctctaaaaacagaggcaaacaggttcttttcaccttaccgtttctatgatcgtgtttaagcaaactcatatagctttcattacatgtcagcgattgttctaagcaatcatgtattaacttattaaattttctaaataactctcttggggtaaaaactataatattcatcttacaactgcagaagctgagacagagacacattaaacttatccaagaccatatctgaaaataggagagaacagagtcaaacccgggcaacctggctctgaatccagctctcgtcttgttggctgtgctgtcttttcagagactggcatctcctgtaagtgcaggtaaatcaaattcccagaagttaagtgagaactggaaaatggtgagtaggaaaacatgttaatatcacaaggaattttaaatagttattaaaacacagaaaggggcttgtatctccctaaattttgtagtgagcacagtgaatttctcacctggcaagaattagaagtctctgtgaatgtataacagattatctgtgtccactctctttgactcccacactcagaaaactgaggctgacatttggatctaaaacatacagccacatattacatgctgctctcttacaaaggtttcaagagagacagacacaatttacaacacactgaagggtaacattttttgctagagatgaattttgcatggtgcccagcaggggaggaatgtagaacacacggacattctctcttcagttctacccttaaatgatccttagaatctgaaaacagctatctcagaattaagtaaggatactattcttgagtatgatatgaatgactaaaaaacaatattttatttaaaacaattgcttggatataaaatctctgaaattgagatttttatttaaaatacatatgaatttaataaacactttaaaacatctttattttcaaaggtaaacatgaagattaagaagaaaggaaaaagtgttatacaggaaacgttcccataggaatttgacatatttgtggttttggcaattatacgtagaacctctggaatacatctacaaaacagatgttttagaggg

SEQ ID NO: 219 - DNA, 3001 bp, Homo Sapiens
  allele 1501: 99-27323-372 : polymorphic base G or C
  misc_binding 1481..1500: 99-27323-372.mis1,
  misc_binding 1502..1521: 99-27323-372.mis2,  complement
  primer_bind 1132..1150: upstream amplification primer
  primer_bind 1610..1628: downstream amplification primer, complement
  misc_binding 1489..1513: 99-27323-372  probe
ttttaaagcacattttactgaaaggtttcctatttgttttaataaataatgccaaagatatggttatctactgtggtataacagaccaccccaacatttagtgacttaaaataataattattttttgtgtccccaaatctgtactttgtgtagggcttggcaggaatggctcatctctgttccacaaggcatcgactggggtggcttggcagggaccggcattttcatttccaaggcagctccccgacacggctgattagtgctggctggcagtgtgttgagatctcaactgcggctgtcattgggggccactctgagggaggcccctggattttttacagttaaataagttttatactacatcacttcatttctttttccagaaacactggcagctaagctgcattttatttgttggtttcttcaataataaatatttcactatttcttctaatcctttgtttccacttattttatttcattcctcattttatcccttttttctaaattccattttattatacttaaggtgcttttaatatggttatcatactcctgatagtgttatttctttcttagtcttcttatataagcgctatacgttcacattccatctcctttggttatctttccatttcttcaccgagcctctttgctctctttttttatagctggttcactcaaaatgtcttactttgccatttttgaaatttattttcattcttttatgtactgaataaaatttaaaaatactttatcatggtgggaggtacccgtgatgtccaaataagtgtttatattaattgttggggtttttttgtttgtgtgttttttgaaaggttaagaaaatctcattcagaaagtaagttgtttaaaaattctggaccaaatttaccacacatcaagcagatacttaccaagttgtttggtagacattagcagtatttactaatgtctgcttctccttgtaagcaaatgtatatctatatttacccctgttactaggaaagaaatcttgtctttggcagtggaaaacccatggagggtttaccggtttctctctgtacccttgttgcaatgatatggtaagcagagttgtgataaattggtttggtcaaacaaaattagaggtatctggcttgcggagaacagctgctttgccatatggtctgagacccacagcagttctgtgtacatgggaaataaacttttattgtattatgtctatgagaatgtgggtttgttttttactgtatcatgattaatagagatgggttaataatttttatactatttctttttcctttgaccattaagaattccatgtgactatgagaatttgcaatacagtgccactctcctttgctttcattgatctacgaaaacatgaaaagctataatctttagaattagtacatccagaacttttcctgtctctattcctatctctttaattgatattccaggctctcatgagtccttgcagttaatccttttcatstttgttatttatatttcttcaaactaaaggctgtattcaatggcaaatctatgcttggttaaagacggagaagaggaatagaggtgagtctgacttgggagatcctttccatgctccccctgattatggtaccaaagttgcagcacgtctttcaacagctcctttgcattgatattttgggaaacaattatttgttctgccttcttcctgcccagtgatatatttacacaggttggtgatgacttgccaatatatttctgctgtagttaaattaatttatctctaactttttttaatcttagtgatttcctaaatttcctgttgttacaattttgaatatgtgatttttatgggaatagcagctttatcaactaaaatataagaaagttaaatgaagagcagctaactactatcataaactaaaaatattaatataagctattaaacaaagggcagaaacatctactaaaaagtttatcctacataagaagtgcttagagcaaagatacaattataaataagaaggtacttaagactgtgagtactttttaaataactcaaaagctgacacagttgagcaactcatttgtatatttgagagcatctgataaattaaaaagtatcattatatgttaaatatgtagatggctggaaatatatatgtgtatatatatatataggtatataaagtatgcaaatatcagcatgatatatttcctaagcaaaaactaaaacttcattaagattttcaggaaaatgttactgagtatcttccatattcccttttcactaaaacataagatattttccattatataataccaagtgcatatcttaaatattatacatctcaactgcattaatctaatttcacatggctatacagaaatacacgagactgggtaatttatgaaagagagctttgattgactcacagttctgcagtgctggagaggcctcgggaaacttagaatcataacagaagaaaagcaggagagatggagtgcaagcaagagaaaggccagatgcttataaaactatcagatctcctgagactcactccctgtcatgagaacagcatgggggaaaagtcctccataatccaatcacctcccatcaggcttctcccttgacacatggtgattacaattcaaaatgagattgtgtggggacacagagccataccataccaccaactcacattctacagctttcaattttctgacaattaaatatattattttagtctgggaatatttgacacgctttgttactacagagcattaagagacagagtcttcattataaatgttagaatatagttgacttgtttccataactactgtttgaatctgactttagagacacgttctttcaaatgcatgcatttgcatatactggaggatgggaagtatttggtacaagagtataagcctagaaatgaatcaaagataggagtaaatttgggataattcaccagcacttctggtcaatggcttc

SEQ ID NO: 220 - DNA, 3001 bp, Homo Sapiens
  allele 1501: 99-27335-191 : polymorphic base A or C
  misc_binding 1481..1500: 99-27335-191.mis1,
  misc_binding 1502..1521: 99-27335-191.mis2,  complement
  primer_bind 1322..1342: upstream amplification primer
  primer_bind 1768..1788: downstream amplification primer, complement
  misc_binding 1489..1513: 99-27335-191  probe
tctctgaaggatgagatcaccaaggaagtttagtagagagggagaacaaaaaagggaccagagaagagagaaaattctttaagtctgcatttattgcatttattaagtgtttatgtaactatgatcagttctgggcaatttatgagtgagcctctaaagtcaggtttccaaaagcaccagcttgaaagaactttcaagtacttatccaagtgtgccattaatcttgtgatgcttaatcagaactacaaaagaaacttttatctgaatcaaagtaaaaatgccaaataaatcacaattagatttactgttatattttgtaattttctttttataattagtttttgatttataatatgttattttctggttgttttttaaagaaactggaaaccttgatagcataatgtttttgatgacctgattcttttaaatatttctttcatatattgacctgttttgcccttaatatatacttgaactgtaaaagaggataactattaatagaaaacctcttataatgcaatgtaggtggtataaatgtttttaagatttattttgattaagaggcattaggttcttgtatccagtttaacttctcgtgttcttatatttaccaaaacttcctctgtctgaaattataatgacaatcttgcctgagtccttaaaattttatatataaaattgaatgtttcctatttgtagtttttcttcattatctggttccataggtgaataaagatggattttttaaaaatacattttgctaattttatttttttaataggaaatgcctatattttctttgggactaagaaactctcatggatcatgtggaggttgcacttttgaataatgcatagttacttcctctaaggtttcttacaacttagtagtttaataaagcaagaaaaggaacaaaagaactgaagggctgaaaataaattatgggtgaaggagcattgtgaggcccttgctgttttcataaggtcggattacttactaacttcatacacagatttttctctccaagagctttgctttttgtaatttgacctggatatttaacacaaaaattatagcaaagaatagctattagactgtttgtataagtggattaatgaacttaatataagtacaaagtaaagaagacataggtatcaatagaaaaaaaaagcattcttcctggaattaaaagatttcttaaagttttttctgtttgtttactttgtaaatagaagatttataagggattaaacttatgtttcactctagcttttagacctagtttgcttaagtcactatggaagaaattataggtcatctaccttttttatggatgaacgtgagagctctttctcactcatcaaatttcaaacgtttttagaacaacaaaatataccttataaaaacataatattcattaaaaagagaaccttgatgagaaatattagtctataagtttttgtgtgtggttttctttttttaatgtaagaaactactmtaatgatgtattagagattgtaaacaatgaaaaacaaaatatcacaaaggcttatgttttaaaaaatggttactttatatctgaactatcccaacaatagcctgacactcaaacaatctacattgtgtagcagaacagttaaaattagtgcagacacctggaaacattccaagcattatgattgctggccaaagacaatttcctttaaacaactaagaaaatatacatgaaattctagtttgaaatttatggaaaagaaaaatgctcatatagaaaagcagcagtctgaagaagattctgcacacataggaaaaaagtcttaaaaattatttgaaaaagtgatgatgacagtgagtaaattcaaattgcaaacattccctcaatatgaatattgcacttagcattatttagacctgtcttgataatgttttcattctctaccctatagaaaatgaagaaaataattatcatatgacatatcaccatgcatatatttttcaataatctctgaatacaaagtaataattttataaaaatctgatagtctcatattatattatatcactgaggccagcatggccagagaacctccgagctccattgtggaattgtgattgtctaataagagtttcatactaattaatccttactttacactctataaaatgcaactcaactgaacatagctaaatcctgtttcaaggtagagtaattcaatattgatagatactttctctacaattattaccaagaagataatttttttaagtggaaatacgaaggctgccattgaatagcaatatctataatactcaagtgactatgcatgaaacactgatcttgaagtttggtttagcctctatcaccaatgcttaccactattcataaatgcagttaaaattgtataggtgtcattaatccagagagaaacagctgtctccattgatgtatcaattgtgtagaagatagagatccatgagtctgtagtcaccattcccagttcactatatttaagaaatatgggaataagtaaatgttatagtgtctaaaatattttaaaagatacttatgtgaaactattttcccatatttcaaaaattatcatcaagtaacagttggcaacatattagatattatttgaagactgtaggagttttgcatgctataataatgatttattttgtaattatcattaattttcatgagcaagtgtccatttgtaaataaaattgcttgattgtctacgagaagccatagatggacatagaccttggcttctattacttgtcactgatgtctttagcattaaatcctaggtaggaatgaggacaatatgcctctcaggatgagtaaatctgattttttcaatgcgtattatacttccttataatgacctggcagttattcgttctctactttaatgccatgactattcatcatatgatgaattttctaaaagtcagtccatcttggtttactacatagatggaacctgcctca

SEQ ID NO: 221 - DNA, 3001 bp, Homo Sapiens
  allele 1501: 99-27345-189 : polymorphic base C or G
  misc_binding 1481..1500: 99-27345-189.mis1,
  misc_binding 1502..1521: 99-27345-189.mis2,  complement
  primer_bind 1672..1689: upstream amplification primer, complement
  primer_bind 1139..1159: downstream amplification primer
  misc_binding 1489..1513: 99-27345-189  probe
  misc_feature 803: n=a, g, c or t
atgaaatttttccattaggacaagttaatattggaagacaaggagagtaagtatgtactctttgtcctgtgtaaatgaaagactcatgttgcatgctagctgttgtttatcttttaggacaagcagacaccaagaaagttctaatactaggaaatgaagccactgcttagttttctcatgaggtaagtgtaattttccagtaatcatatgatcttacatcatctactctattccctgtcaacagtatatgttgttaaatttcatatttgtttagttgtaaatggattaaaataaagttttatattgtaagcagctttaatactacttatttttacctgcatggaagacatgctccaaaaaagtaggtttggtgtcatatgaaacacattcaaacggggaaaggaatttataaaatatttgacatgccaataagtctaatgtatacactctaaattttgcctattatttttattgtagtttttatttttgtattttctatttcatatttctattttttgtgttatatccaagaaagttatgagaagtatgtaatgttagcattaataatgttatttttgtcacaagtgtctcaatttgaataattaaacatatttttagtgcccaccatgagcaaatcatacctacagtagggacataaagaggtaatacataccaattctctgttgcaccccatctccacttgttaatgtactaaagaccaatggaatcaatgcatacaaactatctatgggttatgccagcaggaaacattggtgaagtcctgaaaacaggatgtgacttgngttgaagcaagtcaaaatctggctaagggactggcaccaacttcctctccttttactgactgggtatactaatgtgatctaaatgatgtggtatgcaggcattgtagtacttcgtcttcagtaactccactctggatgaggccaatacaactactcctgtagggtgaaggggtttcccattaagcaagtgtagtgctatggtagtgttcttctcattgctgcacagacagtgctgtttcgttttctttctatggttttaattgtaactgagatgttaacattattacatagaaatctattagttcatttagactttcatttattcatttactcaaacagaatttatcggtgtctgctgcatcaggcactgtgctagatgctgagctgacccaagaaatacagtatgcatgtcactcacgttgtgaagcttgcagttttccagaaaacaagcaaatgcaacagaaaaattaccgtacgtattttataaaaattacaactacaagttctgataaatactgaggaagggggcagggccagctttattgtttcccaggctgtgccatcattctgggtcctgtagaaggacctgcttttggactaacactctgctggcacctcctgaaaattctgaatcattttctagtgaaggacatcatagtttcagttttcactgggccctaaaaattatatagttgatsctgagaagatgctaccgtagttataaaaaatgaaacacctaatttagatatggtaatatgggaacacttactcagaaggtaattccaatccggttttaagtcataagtacagagtaaaattaactccaaacccagttctgtccctactcatgagctaactagaactctagctaaatccgtgtgggttacaagaaataacaaattacctggtggaagaagacatataggtattcaatacatttacaaattcttttaaaaattttatgaagaaatcacttcataaaagcaggcaaaagatataaaatttacaagataataaataaaataggccaataaaatattttaaaacggtctgtctcaataatcattaatataaaaataatcaaatattggataatcaacttcacccataaaattgtcaataaacagtataatatccctagttggtatattggtcagtgttcttgttgcggggaacacttgcttaatcttgattgtatgggaatgcagtttattataagaaaaaaaaacttgataactcacagagttgggaaggctgtataagagaacaaagcttaaagctaagctcataggaatagtgcctaaaactgtgctcagtaattgctctgaaaagaaaatcaccacaaatgttattagcccacatagcaaaagggaaagccattgttccttcctctgtactgatgcctcttctgaattgggaaatgtataaccactgcacccagtaggctgaccctcattccattacatctatcagcaaaatgaattttgtaaagggctttcttcgtcaactctactgtcacacaataagcatcgtctgtttttaaaaagaaagataaattaaatgttttccaagttcaaaatgtgtacttataaaaaaggaatagttaaaccacaaaatggaaaatatatttacatcttatttgacaacagatttatatacctatacaagaactcctataagtcaacacttaaaaggaaaatagcacacacaacaaacacagaattacaatataaccccaatattccactgctcattatatatccaaaaaaacctgaaataagtacatctaaacaaatgtttattgcagctctattgacaatagccaaaagttggaaacgacccaaaagctcatcagcagatgaatggacagacaaactgtggtatgggcatacggtggaatattatttaaccacagaaaggaatgaggtaccatcatgtgttacaatgtgaagaaagtttcgtaacattatgccaaattacaaattcttttaaaaattttacacaataagtcacattctaaccagttatatgtattactcataatacataaatccttagagacagaaggccgactggtggtcgccagacactaggggagtcggggaggaggaacaacggcttaatggtaagtggctttcatttggacaaatgaaaatgttttagaactagagagaggaagtggttacaaatattgtgaa

SEQ ID NO: 222 - DNA, 3001 bp, Homo Sapiens
  allele 1501: 99-27349-267 : polymorphic base G or A
  misc_binding 1502..1521: 99-27349-267.mis1,  complement
  misc_binding 1482..1500: 99-27349-267.mis2
  primer_bind 1748..1767: upstream amplification primer, complement
  primer_bind 1337..1355: downstream amplification primer
  misc_binding 1489..1513: 99-27349-267  probe
  misc_feature 182,848,1501,2206,2397: n=a, g, c or t
gatgccaggcaatgtgcaaatctgcagttgctgcaccgtgcggtggctgagacttttccacataattttaagtgggaagtaggttaggtggcaactttgaacaagaaaaatatgaagtgataaatgtgcgtgtgcatgtttgggggtgggtgggtacgctcacatgcactcacgtgtgtaangtgcatatcaggacctggacagctaaaggacaggatgtccaacttaaaaaaaaatagatttcacccaacaaatagttatgatttctcacatatatacatatatacatgatgttatcaaatgtaactaagctgaaaacatggaaatccccttactagagctcagaatttccaattcttcattgttttactttcactgaagtggtcagccatagcatatgcaaatctatgtcaaatgtaggtgaaacaaataccaataactggctgatgatcgagacaaattacacttatatacacacatatgcctgtacatatatagacatatatgcaatcatttccaacataataaagtacctatactttaaatactacagcacctcataaaagggcatagaatttcatatcagaatctgtgtagcattcttctttatatgcttctcactccactgctcctattgcaaaccaatagtaaatatatattttttctattttattttctacttaattattcatattcctcaataaatgtttagcacattttaaaaaaattacatacctaacatgccagcaacaatgatgagctaaatagattttgtgcttagcttcataaaccaataactatttaaatagatttatatcgaaaaaatcccaaagacatattctttaaanttttgcttattactatatgagagaatctattctaggtctttaggggataaaaagattaatcttaccaagtaagactttatagtctcattggagagataagaccaacataaaagtaaatctaatataaggaaaactaaggaaaaatattaaaatgacaataaaagtatacttatattttaaagtaatttcaaaagaagaaattatttcagatgattcaattactttcaataaatcttttttgaatgttaggatagatgataaattttgctaggtactaggactaaaaagatgaatatggaaaatgtttgccctcaaggtgaataatgcattgtggagaaggtaattgttaatcagagtattgaagaaagaggggaatgcagaaaagtgaagattcagaagaagttatttttctgttcctgcctgagaatattctgaaattgagcaccttcaagcagcgatgaacacgtcaactagggctgactgagtatgcgaagtgtgcttgaaatggaggggtaggatatgagagcgaaaagatgaagcagctgccaggggccttcaatagctcctgactgcctatctgtattatgttggataatttgaacttgaatgtgattaagggagcaacatgataagaaactatgatctaggatcartaatctcggtttagaacaaaggtggtttaggctaaaaagaatctagagttagaagcctgttggtaagttttattactggacagaagggagggaaatgagggaaagttatgaagggctcatgttttagtaggatttaaagaaaaggacacaaaagacattgcagagacaagcttaaccttagctaattcatggatatgggaacaagacagggagtagagtaaaaaccaaagctgaatgcttaaacttggttggcactgaagctggtacaattaaggtagaaacaaaagaattagaggaaataatttcaaagagcagataatgagttttgcgttgaacctattgggtttgaagaccaagtgtgggtttgtggtggcatgttcattgggcaattagaagtctggaactaaaactcaggaaatggttgaagtggagatgaagatttgttaattttctgaagagaactgtgacctgaagtcatgagatttaacaagattatcacgagagaaataagaaagaatgagatagtccagggaagatcttagaaccctcatatttggagaagggaggtggtatacaaaaaaggagcaggcaggccaggcacggtggctcacgcctgtaatcctagtactttgggaggccgaggtgggcagatcacgaggtcaagagatcaaggccatcctggccaacatggtgaaaccctatctnttctaaaaatacaaaaattagctgggcatggtggtgtgcacctgtagtaccagctacttgggaggctgaggcaggagaatcacctgaacccaggaggcagaggttgcagtgagccgagatcatgccgctgcactccagcctgggtgccagagcaagactgtgtcaaaaaaaaaaaaaaaaaaaaaaaaaanggaaaagaaaaagaaaaagaaagcaggcaaaggaaacagaagaaaagtcaaggtttttttttaagaaaagtcaaaaggaacctacataaggacaacatgaggtcagattacagtgcataaaacaatgtctcctttgtaacacaactcatttattagggaaaagccaatatttatgttttgctttcatctttaataggcatacaaggaatgttcacttactctcagacatttctatttttaaaatatgttttgttttaagctaaaacgttgatacctagaactatttttgcaaatattattcactgaagagtttcatgttactgtatgtatagtgatataattctagcaaattgctgtcataagtatacattttatgaaattgatcttagacagaggtaattaagtttgacatcagtcttgcacttaaggagtttcaacaactatactgcaatatattcagcagcacaaggcatctggccacaaaaagctacagaaatttggaggaggagaatttggtttctgtttggagaaccactgaagacccactgaaagaagaaacatctcagatattaactaaattgtgtggaccaatcccccttgcgct

SEQ ID NO: 223 - DNA, 3001 bp, Homo Sapiens
  allele 1501: 99-27352-197 : polymorphic base C or G
  misc_binding 1502..1520: 99-27352-197.mis1, complement
  misc_binding 1481..1500: 99-27352-197.mis2,
  primer_bind 1677..1697: upstream amplification primer, complement
  primer_bind 1250..1269: downstream amplification primer
  misc_binding 1489..1513: 99-27352-197  probe
  misc_feature 365,1072,1760,2273,2939: n=a, g, c or t
tgtatttttaaaaagtcttcggatgatgatggtgtgtagattgttttgagaaccactggtgccatgcattagcaacacaaagaatataaggctggttacaaacacttgtggaatagatgccaattcattaacattttttgtgtatcagaagcttcagggtaagtctcaagtagggtgaacccggttcagggtcaaattatgtatagcaatatctgaaggatttcttgataagagacaattgtttgttgttgttggtggtggtggttttgtttttgaaaaagaaatttgcgggcccggcacagtggctcatgcctgtaatcccagcactttgggaggcccaggtgggtggatcacgaggtcaaggnatcgagaccatcctggccaacatggtgaaaccccgtctctactaaaaatacaaagattagccaggcgtggtggcgggcgcctgtagtcccagctactcaggaggctgaggcagaggaatcagttgaacccaggaggcggaggttgcagtgagcctagatcgcaccactgcactggccacaaagcgagactccatctcaaaagaaaaaaaaaaggaaaaagaaatttgcttagacagatcaaagagcctatgccctgttcttcccagtgtagggctgttttttgaccggaacatggactgaaagtgcatctcatgttctagaggccatggcaatttgcggcacgtaagatcaccaatatcttcttggtagggatagcactcttcccataatttgaacttcagaatatcgtgtaggctgtaacactaccttgctcagtgcttggcatacactaggtgcttaacagtgattagaatcccttcactgtaactgtcttgttggtatgaaaatacaattttaaaaacagaaaaataaaacaaacctctactttagatcatggcgtgctaaaacatccagtaaggagtgttctcttatttatttatttatttttcctggagctcctgggcctgcagtggagaacaatgtgtccgcagttatttcctacttttctaaggtagtgagaagaatgctgaagctatgcacttaaagcnaattattagtaacttaaatggcattccaagagaacagagaatccaaactcagtgcttatgttttaaaaacaatgaagcaaagctataatgttggcacactttgcagcactttgttatctatttgtctacacatttcaggaaaatgtttctggtttgaaagttcaaaacaagctaaagcttcaaacggaggctgtgaggttctttattcttttgttttaatggtagcataacgacataggacatctgagctcatgctgtacagcgacatcctttagccgtttccattagacatttatgcctggtattcttaaatgaaacataaaatattggtatgtatttttccctgacaggatatgtttgagatattgctgtaagatgtaatcaaattttaaaggcgataggagccctaaaaaaggaagaatcattcasgttttctaatcacagccatgtgagtaatggcatctggcgactcgggaacgcctgctaagttttagtacttgtctgaaactagctaccacgtgattgcttagctgcctggtctttttaaggttgcctgaaagggctctgctataaacttacttatttatcctatttattggatgcacccacatcacataatagtctctgggtacatttacaagggtaataaaagaggctatacagttctttcttggcaattggatagagnacctagagttcaaaggagatacaagtgtatgtaattcagctgttgcacttttctttacaatttttaacatcttatatttaaatttttttttagggctgtgaatcaataaaataacaaaaaaagagtatatgctttcaactgagacgttaaagaaaataaaattacagagagccttttacagttttcttccaggcagtccacactaaggggcaattcctttaggacgagcactgtgttggaggctctgttttcataatcagaatagcacatcccgtgtgaagaagaggctttgagtccacattcttcctggatttcacatccgattaatgaggatgccaggcaatgtgcaaatctgcagttgctgcaccgtgcggtggctgagacttttccacataattttaagtgggaagtaggttaggtggcaactttgaacaagaaaaatatgaagtgataaatgtgcgtgtgcatgtttgggggtgggtgggtacgctcacatgcactcacgtgtgtaangtgcatatcaggacctggacagctaaaggacaggatgtccaacttaaaaaaaaatagatttcacccaacaaatagttatgatttctcacatatatacatatatacatgatgttatcaaatgtaactaagctgaaaacatggaaatccccttactagagctcagaatttccaattcttcattgttttactttcactgaagtggtcagccatagcatatgcaaatctatgtcaaatgtaggtgaaacaaataccaataactggctgatgatcgagacaaattacacttatatacacacatatgcctgtacatatatagacatatatgcaatcatttccaacataataaagtacctatactttaaatactacagcacctcataaaagggcatagaatttcatatcagaatctgtgtagcattcttctttatatgcttctcactccactgctcctattgcaaaccaatagtaaatatatattttttctattttattttctacttaattattcatattcctcaataaatgtttagcacattttaaaaaaattacatacctaacatgccagcaacaatgatgagctaaatagattttgtgcttagcttcataaaccaataactatttaaatagatttatatcgaaaaaatcccaaagacatattctttaaanttttgcttattactatatgagagaatctattctaggtctttaggggataaaaagattaatct

SEQ ID NO: 224 - DNA, 3001 bp, Homo Sapiens
  allele 1501: 99-27353-105 : polymorphic base T or C
  misc_binding 1502..1521: 99-27353-105.mis1,  complement
  misc_binding 1482..1500: 99-27353-105.mis2
  primer_bind 1584..1604: upstream amplification primer, complement
  primer_bind 1085..1105: downstream amplification primer
  misc_binding 1489..1513: 99-27353-105  probe
  misc_feature 794,1501,2189,2702: n=a, g, c or t
tggagatgctttggttattgcatttttcaggatcacctgagacctcatttaagaatttttttttcattcattctctgaaagagttccctatttgatttcctttgggtgaggcaatgcgataaataggatgagcatagaatttagagatggatttacctgccttatcatatgaagcctaccattcacttagatatacaattttgagcctattattattcattccttagcctgactcctacttcgtaaaaaatacaggtaaaatccctgcctacagaagttttgtaagtattaaattaaattttatatataaatgttgtatatatgtatatacacagtatatacatataaagtctagcgcagagtttcaaatttggttgctttgaagaatctactatgaattctgtaagtctgggcaggagcccaggcatctgtatttttaaaaagtcttcggatgatgatggtgtgtagattgttttgagaaccactggtgccatgcattagcaacacaaagaatataaggctggttacaaacacttgtggaatagatgccaattcattaacattttttgtgtatcagaagcttcagggtaagtctcaagtagggtgaacccggttcagggtcaaattatgtatagcaatatctgaaggatttcttgataagagacaattgtttgttgttgttggtggtggtggttttgtttttgaaaaagaaatttgcgggcccggcacagtggctcatgcctgtaatcccagcactttgggaggcccaggtgggtggatcacgaggtcaaggnatcgagaccatcctggccaacatggtgaaaccccgtctctactaaaaatacaaagattagccaggcgtggtggcgggcgcctgtagtcccagctactcaggaggctgaggcagaggaatcagttgaacccaggaggcggaggttgcagtgagcctagatcgcaccactgcactggccacaaagcgagactccatctcaaaagaaaaaaaaaaggaaaaagaaatttgcttagacagatcaaagagcctatgccctgttcttcccagtgtagggctgttttttgaccggaacatggactgaaagtgcatctcatgttctagaggccatggcaatttgcggcacgtaagatcaccaatatcttcttggtagggatagcactcttcccataatttgaacttcagaatatcgtgtaggctgtaacactaccttgctcagtgcttggcatacactaggtgcttaacagtgattagaatcccttcactgtaactgtcttgttggtatgaaaatacaattttaaaaacagaaaaataaaacaaacctctactttagatcatggcgtgctaaaacatccagtaaggagtgttctcttatttatttatttatttttcctggagctcctgggcctgcagtggagaacaatgtgtccgcagttatttcctacttttctaaggtagtgagaagaatgctgaagctatgcacttaaagcyaattattagtaacttaaatggcattccaagagaacagagaatccaaactcagtgcttatgttttaaaaacaatgaagcaaagctataatgttggcacactttgcagcactttgttatctatttgtctacacatttcaggaaaatgtttctggtttgaaagttcaaaacaagctaaagcttcaaacggaggctgtgaggttctttattcttttgttttaatggtagcataacgacataggacatctgagctcatgctgtacagcgacatcctttagccgtttccattagacatttatgcctggtattcttaaatgaaacataaaatattggtatgtatttttccctgacaggatatgtttgagatattgctgtaagatgtaatcaaattttaaaggcgataggagccctaaaaaaggaagaatcattcacgttttctaatcacagccatgtgagtaatggcatctggcgactcgggaacgcctgctaagttttagtacttgtctgaaactagctaccacgtgattgcttagctgcctggtctttttaaggttgcctgaaagggctctgctataaacttacttatttatcctatttattggatgcacccacatcacataatagtctctgggtacatttacaagggtaataaaagaggctatacagttctttcttggcaattggatagagnacctagagttcaaaggagatacaagtgtatgtaattcagctgttgcacttttctttacaatttttaacatcttatatttaaatttttttttagggctgtgaatcaataaaataacaaaaaaagagtatatgctttcaactgagacgttaaagaaaataaaattacagagagccttttacagttttcttccaggcagtccacactaaggggcaattcctttaggacgagcactgtgttggaggctctgttttcataatcagaatagcacatcccgtgtgaagaagaggctttgagtccacattcttcctggatttcacatccgattaatgaggatgccaggcaatgtgcaaatctgcagttgctgcaccgtgcggtggctgagacttttccacataattttaagtgggaagtaggttaggtggcaactttgaacaagaaaaatatgaagtgataaatgtgcgtgtgcatgtttgggggtgggtgggtacgctcacatgcactcacgtgtgtaangtgcatatcaggacctggacagctaaaggacaggatgtccaacttaaaaaaaaatagatttcacccaacaaatagttatgatttctcacatatatacatatatacatgatgttatcaaatgtaactaagctgaaaacatggaaatccccttactagagctcagaatttccaattcttcattgttttactttcactgaagtggtcagccatagcatatgcaaatctatgtcaaatgtaggtgaaacaaataccaataactggctgatgatcgagacaaattacacttatatacacacata

SEQ ID NO: 225 - DNA, 3001 bp, Homo Sapiens
  allele 1501: 99-27360-142 : polymorphic base G or T
  misc_binding 1482..1500: 99-27360-142.mis1
  misc_binding 1502..1521: 99-27360-142.mis2,  complement
  primer_bind 1361..1381: upstream amplification primer
  primer_bind 1793..1812: downstream amplification primer, complement
  misc_binding 1489..1513: 99-27360-142  probe
ttgtttcataatcagataccattaggtggtctgtgttcactgtgatgctggtgaatccacactctcaatgtcgcacacctgtctgtgttttgacttgcacttgtcacatgaggtcaggtgtggaattttccacttgtggtgtcatgtgggcactcaaacaatttcggattttggagcatttcagattttcagattaggaatgctcaatttgtatctaactttctaaacctgtgaatatgagactgtatttatctatctcaagaacaaacatcaaaatatgtccatcagtgatagattggattaagaaaatgtggcacatatacaccaaggaatactatgcatccataaaaaggatgagttcatgtcctttgtagggacatggatgaagctggaaaccatcattctcagcaaactatcgcaaggacaaaaaaccaaacactgaatgttctcactcataggtggcaattgaacaatgagaacacttggacatcggaaggggaacatcacataccagggcctgttgtggggtggggggaggggggagggatagcattaggagatatacctaatgtaaatgacgagttaatgggtgcagcacaccaacatggcacatgtatacatatgtaacaaacctgcacattgtgcacatgtaccctagaacttaaagtataataaaaaaatatggtagctgtctgaatattatctaaatacataggatatagaactcccattatgagttgtaaaattgtaacactttgagaagtaaagaaggatggagtaaagattgaaggttggaaatggaggcaacattctctgatatgcttttccctgatataatatttgacatacaatcaatacaaacattttgctgatacaataatagctagagatattattatgtctttgtaacagagagatgtttaatatgaaataaatgatgcatagtagatagcttaatttgcttggtggcgaaaaacactgcctaaatcctttggggctgaaatttgctgatttcaaaatgtatgccaatcacttaaaccattttaaaatttcccttttcttataataaattacaattattaaaatatcacccataagaattgaaaatcaaataaatttttgaattatacttcatgtattcttataaagaaatggaatcaggaatatgtttcaaaaagatctttgtcaattataactatcattgtattactagggtttcattaaaactggattttctctactttttttgtattttggttaatgagttatttgtgatttattctatcttaattaattttgccttctttttaaatatatctggaaatttaagagtgtaaaaagtgacaattaaaaatctttacataaccaaaagtagatcaaggttacatttcgctaggttggcaataaaattatccatataattacataattcattcccctaaaatattattttggtaagttacttaaaaattttggcacatcttgtgttccttttgaagakaaatcatcctatatatttcaatatattttagatttttttctaactccatctttgttttaagaaaaatcaaagtttataaactatgtctatatttacaaaatcactgtgtcagagcatgacttttaatcatctctgcactttaacacaggccttaggatatttacaaaaattggagaatcaaaattagagagttgcaaacacccttgaaatccatctagtccagtcatctagctctccacttcttagtaccacaggctaaggagacagactgagcagtcaaggtaacaagcccctctaccctttctttgtacaaaacaatttcagtgtttttgaagtatttgtaacaatgttcttagcaacttcattataccatttaacaagaatacattgaaaatcaattccccaacactcattttgtacgctaattttgtaagatcctgaaaagtttcactattttatggtttcatgtgttacagatgaaaaaaaaactagaattcaaattttctgagtttttttttacaatattttatgattacaaagttagaagactaagaataaaatggcctaatttccataatgtgagtggtaaatgcagagcactggcctaaagaaaatatttcaaaaaattagtcatcttttccttaatttttttccaacctatgatctgttgaatgagcattttgcatatataaataaataaattactttgtaaataatcttgactggtttctgttgaccacagtaacccactgcacagcacagcctgtaatttctatgaacctagggaaatgtatttaagtttattttttgattacacaggtcctcattgtgtaactaaacattgcatagaatatgccagtgatgatggagaaaagctgtcaaaatcaatatttaggggagaggtagctgctggcagctctgacacattgaaaaagttcagtgactcaagtacaaagacaggagaaaatcattcaacaaaacccctgaaatgtgtacttgtttttcctgacctacacattttaattccaaaaagagtgggaggcacataattatttttgtcaacatagattcatcaaacacagggcaaatatattcagaacaatggagatatttccttcctgccaattcaagaattattaatttgcctgaggaaaacgtttacatttatgatggtatatacacatgtctacacacacatatgcatatgtaaaagaaaagcgtatcaaaatctaactgtgccggaaagtaggacacaagtgttagctgcattcacaatgacattgcagtgacctcatagcttgctttgccacagtttgctgcctttttcattgttgttcaaaggaagataaatttcaatatttcccttgcttgcataacatggtgtcgcattccagactgttggtagtgtttccacatataaattattggtctagcacttcacagaatctggtacgctgctattttcagcagtctatgcttcctcccagcctcctccttggt

SEQ ID NO: 226 - DNA, 3001 bp, Homo Sapiens
  allele 1501: 99-27361-181 : polymorphic base A or G
  misc_binding 1482..1500: 99-27361-181.mis1
  misc_binding 1502..1521: 99-27361-181.mis2,  complement
  primer_bind 1322..1340: upstream amplification primer
  primer_bind 1815..1834: downstream amplification primer, complement
  misc_binding 1489..1513: 99-27361-181  probe
gtgactcaagtacaaagacaggagaaaatcattcaacaaaacccctgaaatgtgtacttgtttttcctgacctacacattttaattccaaaaagagtgggaggcacataattatttttgtcaacatagattcatcaaacacagggcaaatatattcagaacaatggagatatttccttcctgccaattcaagaattattaatttgcctgaggaaaacgtttacatttatgatggtatatacacatgtctacacacacatatgcatatgtaaaagaaaagcgtatcaaaatctaactgtgccggaaagtaggacacaagtgttagctgcattcacaatgacattgcagtgacctcatagcttgctttgccacagtttgctgcctttttcattgttgttcaaaggaagataaatttcaatatttcccttgcttgcataacatggtgtcgcattccagactgttggtagtgtttccacatataaattattggtctagcacttcacagaatctggtacgctgctattttcagcagtctatgcttcctcccagcctcctccttggtggtatgactgttacagaaacattagagggaacagaaatgctgccagtgcacaatgtgagtggtattatgaggaatcagattgctaaaagcatgcatatttgatgaagcaagctaaacaaggttatactgtttaatagcctaaaaaggcaaataataatatatgagaaatcatttctatatctgtaggtgtaagaacccaaagttagaaaaaaacatcttttgtcgggattaaggaaatttattcaatgacatcatagcaaataaaatcagatttttttatgtgagtaaactattaatgcatagcagaattaataatcttgtagcaatgataccaaattaattttatgttttaagcctatgatataagttagtttccaaggacaaagcagtgtgactaaagccctctgtaaaatatcatttcctaaataataacaatacacctgtttgtttttacacttttaaaatttttacctctctgaataattgagaatttgaaatcatcacacaaggaaagcaatatgctttttatttgcatatagcatgttcttttcattaaaaatgtaatatggtgagaggtaaacaaatctgcccaaaaaaagtgtgcaaacctgccagcctaagtggtacttcttcttaaaaattgtactgattttatttaacaaaaagttcaagtgataattctaaataaatagaattgcattgtggaacatatgttatcacattaatcatttgctcctactgctatttcatacttggtggtcattcttatgccatatctgtaattatgacatttttctttactctaatgtcaactgattactgatgggcccagaaatggctttctgttaacaagcctggagcagctttgtgcaaaaaggcttttgggaataaagaattgatttgtgcatcttgcaaacagaagaaatttgggataactcarctagtgactagaagaatcccttctctcagagtaaattccagtgaccatagagtatggattgttgaccattcttgacatgccattggtcatggtgatggacattgcatgcctgtcccaagacggacattactgatcatgacaatgtttgaaataggaaaacaggctaatagagttaaagtgaattgcttgtagtctcacagctaataagtgacaaagcaatcattggaaactaattctgtttgttttgcttttgaatggaagaatgttagatcctaatgtataatgtttagttcaatgcatgtcatgataaatagacatttaccaaaagcatacatttgtcaaagctctgaagtgtttggctgtgaatggagactcaagacttattactcaaaccaatattcatacagtcttctcctgttgacattcatgctaatatttttatctattttataaccgaagtgcttttgtatatttttgattataattttctgagtagaagctgtccttgaataacattttcaagacaaactacacaattattgtagtagaaatatggattcctttccaggtggtatttgagatcactagaggacagtaaggatttgtagaggtcatttgtttttttaaaaaaaatttaataaccctctttcacctttccctaaagaccctaaatctgaggaatcaacagggcagcagatctgtatatttttttctaagagaaaatgtaaataaaggatttctagatgaaaaaaaaaaaaaaaaaaaaaaaaaaaatttaataaaaagcatttatagttgtaatttattttaatttccagtatgtacgtatttaaagcaagtatagataaaatttactttgtgatagcatcaatgtttaattaatcatttgctttttcaatcttgaaagctagtgatgtttacattttctgtttcaaatcaaccatttttaacttatattacatctacaagaggtaagaataaaaaaattgaaatgacaaaaaaggattatcaaaattattacgatgtggaaaacaatcttgagcgtaatctgtagctgagtaaatagcagaatgtgaagcattatgaattattttatagactttggaaaatatgaacaaatataattgtttatatttacaaaatgtctcctatttctatacttcctagatcaagctgtgttcattattatggtgccgctgccgcctagttagcctatcactatctagagtcatcagctttccttaaagcccttttctctcctccccttaaagcccttttctctcctcccattaaagccctttactctcctcccctcacctaaagtaagttaaatacatttactcacagaactagaagtgggtggactggctaatgaatggtttagctttgaaattatacttacagaaaatattagattaaattatgggaaaacatttccccaaatgatttttctagtactatgcctacaagctttgtgcttcaaaacagtagtgagaacaa

SEQ ID NO: 227 - DNA, 3001 bp, Homo Sapiens
  allele 1501: 99-27365-421 : polymorphic base C or T
  misc_binding 1482..1500: 99-27365-421.mis1
  misc_binding 1502..1521: 99-27365-421.mis2,  complement
  primer_bind 1081..1099: upstream amplification primer
  primer_bind 1590..1609: downstream amplification primer, complement
  misc_binding 1489..1513: 99-27365-421  probe
tcttttctttcttttctttctttctcaatctcaccctgtcatccaggctgaagtacagtggcacaaatgtagctcactgcaaactcaacctcctgggctcaagcaatatttctgcctcagcctcctgagtagctaagactacaagtgtgtgcctggctttttttttttttttcttcttcttcttctttaacgttttgtagagatgaggttttactatgttgcccaggttggtaaattccttagctcaggcgatcttcccacctcagccttccaaaatgctggatttacaagcatgagccactgcatcctactcaatatcagtttatttttatgagctcaccagtcatggatgaaaactgactcctggagaaggggttaaaaagagaatgcaagatgaatgtttgactccttccttttcttctataagttttcagaataatgcctttttttttccctaagagtcctgatcctaggtaccagtagtgctcattccttttgagtgggtcagcgtttctagtcattttctgtgggccggatgagggtatctttattttttttttaataagagatgccattcatctgatttttattgataatacaggtgttctcttaaaattttttctctcttaattatgtatttatttctctcatgtcaaaattccagttcccagtaacacagacatttgttttcatctaaatacatacacagtagtctctgtgtgagaataccagacattggaagagagtcacttactgatcagggagtcctgagcagatcttaccaaggagagatataaacttctatagtgtaagcttttgagcttacactatacaattttgggaatgggagttagttatctgttaaaacagttaacagcttctttaatacataaagtatctaatgcttttgccgtaccctgcttaaaagtttgtaatatcaatcggtactgtgaataaattacttaccattctgcattgcaatggatatcatgacttgaatagcaatagatacatgtattgagatctgtgtgaagggtcaaatacaaggaaggattttgtagtactggactagaaaatattttatcctaagtggaaacagaacatatgggcatgtaagcagcttgagcatgtacttcaattccctggtaagaaatctcctcttgaaaatttgagtcagatagtctgaagtgttctgctggaatgaaatcaatatatgaaatttaaaatgttggagtaatctgcacttaggtaaccatgcagtgcagtgacttcatgggtgccttcagattagaacaatataaaatttgaggagcaaaagtgcaaacatttgagaaatgctcatagttaagtggtgattgctgaggagatttaaaagaaagaaatacaaaattaatcatagaagaaagaagataatatagtgccaaaaaacccacaagagaaatagtttaagaagtgaataatacattaaataagacagagaaatcagcaatacaagacaacygaatttaaaacttaacagattatttgtgacctgaccactgagtaaaaatactcagtaaagtggttggaatggaaacagtattgtttctcaagggtacaataaaagacaatgacttggagaggtgactgcaaaacagagtgacaagattctaagtagagccataagactcactgtgaaaacaaatgtcctgctctatttggttctaaaattcattatctgcaaaagttctacaatgctgaggggccatattttgtttgtatgtttcaactcatactttacctctgctgcctcacaatagcctgcaaaaatagccactgccccacaataccttggaagtaggaactgcgcctcacgcaggccgcctacaggacagggaagcagctggagacccatgagatggctgaaccaaacagaatccagaccgggcttgctttggaaatgtggggcaagaaataccaattaaataaggcagtgagtggtgggaactaaactaaaatgccatctggtaggtcatggatggagagaaccacggggctatcgataagccaaagctgcaagctgtcagtgactctgtgaagaaaccgaaagtcaatgcgtgcagcgagaagagggtgattgaggaagtgctgcagcatggctatgggcgatagaaagactgcagctcttgactcaagcacggagggaggaggtggttttgaaacagcctcggatgctgacagattgccttctgtagctctaagtccttaaaataacccaactcggtggctgtgtgtggttttgtttgttttgtttgacccaaatagcttggaagactcagacatcttctgtagtctcggttctagcagtgccagagctagatgaacctggtagtttaaattttcaaagggttggtaaacgatgtatggtaagcaggaaagaaaggataatgagcacagtaagaggaactaggggaaaggtactttggtgaggctgaaactgcttcagttcccgctctgcctctctctctcatgaatcactatgacctgaatagggagaaaacgaacgcacatgttggaaatcaggttgagcggatttcacgtcatttccacatagcaccctatccagtgagaggaaattatctgcctctttgtgaaagtgacagggatgtgcaggcacagtgcaattccttggggaagtgagggcagtgtctgcatatagttatcaagcaagaaattgttgagtgttgcgattgcaaagaaaagaacagaattgagaacacccgagtctttatcgatcaagccccagaatagcagtcatgacagggcaggttatgagtttagccagctgtgtgaggtaacaaggcctcctacagctcttcttttgggagcttcagttgagtgataagtcatcctctctctagagtaaggcagtagcaggaaacagctgtatgccaattgtaaattctcccacatttcagtggagatgtagtccaggtcttacttgcccctgtggattatctaa

SEQ ID NO: 228 - DNA, 526 bp, Homo Sapiens
  allele 484: 99-27680-484 : polymorphic base G or T
  misc_binding 464..483: 99-27680-484.mis1,
  misc_binding 485..504: 99-27680-484.mis2,  complement
  primer_bind 1..18: upstream amplification primer
  primer_bind 509..526: downstream amplification primer, complement
  misc_binding 472..496: 99-27680-484  probe
  misc_feature 57: n=a, g, c or t
ggagacaaaaaatcacggcaaattacaaattataaaagctaaaaattacctcaaatnttataaaatccagtatactaataccttgaaatacctctataataacattttttatgtattttagctatatactttaaaattgtttttattgtggtaaataaatataaaatctgccatagtaaccatcttgaagtgtacaattcagtgacattcagtgcatttatgatgttgtgcaaccatcaccactagctgtttccataatagagcctggaagagctattcacttaaaacacgacgggaagaacaccaccttgagttgtacagtgccaaggcccagaacatgctgccctctttcacttccaagctttggcacaatttttccctctgccagaagtgccctaattcaaacccttctgctgttcctactcacttctcagtcccaacccaggtagatgtttgaagcccttatggaatccccccagattakattgggtgcccttcctctgtgcttctactccacacttactca

SEQ ID NO: 229 - DNA, 3001 bp, Homo Sapiens
  allele 1501: 99-27912-272 : polymorphic base C or T
  misc_binding 1481..1500: 99-27912-272.mis1,
  misc_binding 1502..1521: 99-27912-272.mis2,  complement
  primer_bind 1230..1250: upstream amplification primer
  primer_bind 1659..1679: downstream amplification primer, complement
  misc_binding 1489..1513: 99-27912-272  probe
  misc_feature 1929,2531,2954: n=a, g, c or t
tccaagaagagtcagtgtttcagtttgaacccaaatactggaaaaaagccaatctagttcaagagcagttggtcaagaagaatttcctcttatatgggagatagtcagctttttgttctattcaaacgtctaactgaatgaggaccgcccacacgaaaaagagcaagttgctttactcactctgctgattgaaatgttatctcatccagaaacatcctcataaacacaccagtaataatgtttgaccaaatatctggacaccttttggttcaggcaagttgacacataaaattaatcatgacaactttcaatagggaatttcacagtttgcatctagaacacctagaactccataatggcaaagacgaagactttgggtctatgtgttcttagtgggaagcactgtgtttggtctataatgagcattaaggaatgcagaataaactatgcattaacattgaaaaaactatatttgacaagttaatgataataaacatcttggtaaaaatgtgtatttcttttaatagaaaattttaaagaattatcctaagtgaaaatatattaggttatgttttatttattttattttattttatttatttattttttgagatggaggagtctcgctgtgtcgcccaggctggagtgcagtggcgtgatctgggctcactgcaagctctgcctcccaggttcacgccattctcctgcctcagcctcccgagtagctgggactaggggcgcccaccaccatgcccggctaattttgtttttgtatttttagcagagacggggtttcactgtgttagccaggatggtctcaatctctgacctcgtgatctgcccacctcagcctcccaaagtgctgggattacaggcgtgagccaccacgcccggcctagatgatgtttttaattaattaatcagatttcttaaaaatatataatttgtctggctcctttatttcagttagtctttaatctctaaagcaatgaagttattcaaccataactcaagtaacaaagtgtccggacatatttggaaaatccatctaagagaaatgaaactatgaacatttatatacctccattaaaaatgtgtctaattcaaatattaaaaatctgaatttataagaattttagtggttttaatatctgctgatttgtcttttaataactttcagaattaattttgtgtaaatattttccttttctctttttttttcccagacataagccccacaaggtgaaaaggcatgcagataaagagtatgccttttctttttcagtgtctggcaaaagaataattgtaaaattaagaggattcttaatctttgacttttgttcaatgttgtctcatccatccagtttttcctgtgctataagacttagatctgtaatgttaataattaattacttaaaaggtaatgtctatgctcaaacaacctataatgttacccctaaaacaatgagaaacaatgacaagttaactaatatggatcctytaaattgtgtgaatgtgtgctgtaagactgaagttgtagttgtttcttagatttaacacagagctacctccttgactataaacttttgttgctatgttgggaaatcagtttggccttaaattgtcttctgtgaataataaaactttccttggagactggattcatggcaaattctctttaggaaaacatgcttgaatttgacacatttgtaaaaccatcgctctttgggactactggcttctgacctctgaatcctagtaattattctaaggccacaaatgtaccaaatattgtccagaagagccgttcactggctccttacttcgtcagtcccattgcttgtagaaactgtgcttcttatatcctggttagaggtctccaggctatggtcttcctacttggttatctcaagctacagctgctcctangttggtgcctccaacaacagttttaacagacttcattttctatgggagactcatgcctgaactcaacttctctatgtctaggtagtgtccacatgcagatattgatataatgtatattcctttatcctttatgttttataagaggagaagggtaccaaaacacttagggggtgataatgactagattgaatacatttatattggatgttatctaaggaagaggctttcaattttcatacaatgtgggagagagctaataagtaaaaaggaaagagttgaaacaatatctctaacaatattggttcatagggaataataagaaaatgggaattgtttgtggaaaaatgctatcacataggttgacctaaaattttaaataattaaactcttttgatacacttttgtttctatcttttccccaaatgaccagcataaaaacctattgattaagcaaatcaagtttgttagactgtagcagtagggaaaaaaaacaaccttgacagagtctcattggagtctctaagtagtgatactattgaagtatatagatgctttagagcctgggatatgtgatttaagggtagatatttcaaggtgtgganctagttggaattgggaaaattttatataataaaatacctttggttttgcaggcacagcaaagaagtgagaatcttgaagtaagccctaattagcaaacttggtttaatagacaagtggtttagttggttcatattcttattttccaggaacaagtaattcctggaacaataatacaagttatttttacttgatcttggtataagtatgcttagtcctagtatggtttaacacaggacaggaactatgctagtttaagttcttggtcttaaactgacctattataccatcccagtttttagagagctatataaaaaactaaggatttttttctcagctatctaccatttccaaaacacaaattttcaccaaaacacaaattcacagatgcaagattctaccatagtcaatatttactatagagntcctagtgtaagaggaatcatgattggactctggtatcccattggag

SEQ ID NO: 230 - DNA, 18 bp, Artificial Sequence
  sequencing oligonucleotide PrimerPU
tgtaaaacgacggccagt

SEQ ID NO: 231 - DNA, 18 bp, Artificial Sequence
  sequencing oligonucleotide PrimerRP
caggaaacagctatgacc

SEQ ID NO: 232 - protein, 30 aa, Homo sapiens
QPLERMWTCNYNQQKDQSCNHKEITSTKAE

SEQ ID NO: 233 - protein, 22 aa, Homo sapiens
REAHKSETISSKLQKEKQIKKQ

SEQ ID NO: 234 - protein, 15 aa, Homo sapiens
MHMKTILGPRLGLGE

What is claimed is:

1. A composition comprising an isolated and purified polypeptide comprising the amino acid sequence of SEQ ID NO:232 or an epitope-containing fragment thereof, said fragment consisting of at least 8 contiguous amino acids selected SEQ ID NO:232.

2. The composition of claim 1, wherein said polypeptide comprises the amino acid sequence of SEQ ID NO:232.

3. The composition of claim 1, wherein said polypeptide consists of the amino acid sequence of SEQ ID NO:232.

4. The composition of claim 1, wherein said polypeptide comprises an epitope-containing fragment consisting of at least 8 contiguous amino acids selected from SEQ ID NO:232.

5. A method of making an SBG1 polypeptide, said method comprising the following steps:
   a) providing a cell or tissue expressing an SBG1 polypeptide comprising the amino acid sequence shown as SEQ ID NO:232 or an epitope-containing fragment thereof, said fragment consisting of at least 8 contiguous amino acids selected SEQ ID NO:232; and
   b) purifying said polypeptide from said cell or said tissue.

6. An isolated polypeptide comprising SEQ ID NO: 232 or an epitope-containing fragment of SEQ ID NO: 232, said fragment consisting of at least 8 contiguous amino acids selected from SEQ ID NO:232.

7. The isolated polypeptide of claim 6, wherein said polypeptide comprises SEQ ID NO: 232.

8. The isolated polypeptide of claim 6, wherein said polypeptide comprises an epitope-containing fragment of SEQ ID NO: 232, said fragment consisting of at least 8 contiguous amino acids selected from SEQ ID NO:232.

9. The isolated polypeptide of claim 7, further comprising a heterologous polypeptide sequence.

10. The isolated polypeptide of claim 8, further comprising a heterologous polypeptide sequence.

* * * * *

UNITED STATES PATENT AND TRADEMARK OFFICE
CERTIFICATE OF CORRECTION

PATENT NO.       : 7,067,627 B2
APPLICATION NO.  : 10/147603
DATED            : June 27, 2006
INVENTOR(S)      : Daniel Cohen et al.

It is certified that error appears in the above-identified patent and that said Letters Patent is hereby corrected as shown below:

Title page,
Item (*) "Notice: Subject to any disclaimer, the term of this patent is extended or adjusted under 35 U.S.C. 154(b) by 244 days." should read
          --Notice: Subject to any disclaimer, the term of this patent is extended or adjusted under 35 U.S.C. 154(b) by 244 days.
          This patent is subject to a terminal disclaimer. --.

Item (60) Related U.S. Application Data,
Line 3, "Oct. 12, 1994" should read --Oct. 12, 1999--.

Column 2,
Line 23, "pituitarys—s" should read --pituitary's--.

Column 17,
Line 9, "A324, A334" should read --A324, A330, A334--.

Column 21,
Line 42, "A177, A197, A199 to A222" should read --A177, A179 to A197, A199 to A222--.

Column 35,
Table 5b, Seq ID NO 27,
"g34872LR1309nBAmH1 ATGCGGGATCCAGAGATTCTCCCAGTCACACACCC" should read
--g34872LR1309nBAmH1 ATGCGGGATCCAGAGATTCTCCCAGTCACACAGGC--.

Column 45,
Line 47, "8-137 8-37-152" should read --8-137 8-137-152--.

Column 57,
Line 12, "a base pairs" should read --a 34 base pairs--.

Column 58,
Line 16, "two loxp" should read --two loxP--.

Column 59,
Line 6, "the send" should read --the 5' end--.

Column 120,
Line 62, "sperm idine" should read --spermidine--.

UNITED STATES PATENT AND TRADEMARK OFFICE
CERTIFICATE OF CORRECTION

PATENT NO. : 7,067,627 B2
APPLICATION NO. : 10/147603
DATED : June 27, 2006
INVENTOR(S) : Daniel Cohen et al.

It is certified that error appears in the above-identified patent and that said Letters Patent is hereby corrected as shown below:

<u>Column 134,</u>
Line 66, "GAL-lacZmef)" should read --GAL-lacZmet⁻)--.

<u>Column 192,</u>
Line 22, "from $1.0 \times 10^{-5}$" should read --from $7.8 \times 10^{-5}$--.

<u>Column 205,</u>
Lines 42-46, "NH2-QPLERMWTCNYNQQKDQSCNHKEITSTKAE-COOH
Control 1: NH2-REAHKSETISSKLQKEKQIKKQ-COOH
Control 2: NH2-MHMKTILGPRLGLGE-COOH"
should read
--NH2-QPLERMWTCNYNQQKDQSCNHKEITSTKAE-COOH (SEQ ID NO:232)
Control 1: NH2-REAHKSETISSKLQKEKQIKKQ-COOH (SEQ ID NO:233)
Control 2: NH2-MHMKTILGPRLGLGE-COOH (SEQ ID NO:234)--.

<u>Column 209,</u>
Line 54, "selected SEQ ID NO:232" should read --selected from SEQ ID NO:232--.

<u>Column 210,</u>
Line 50, "selected SEQ ID NO:232" should read --selected from SEQ ID NO:232--.

Signed and Sealed this

Twenty-third Day of October, 2007

JON W. DUDAS
*Director of the United States Patent and Trademark Office*